US008324368B2

(12) United States Patent
Gollob et al.

(10) Patent No.: US 8,324,368 B2
(45) Date of Patent: Dec. 4, 2012

(54) GNAQ TARGETED DSRNA COMPOSITIONS AND METHODS FOR INHIBITING EXPRESSION

(75) Inventors: Jared Gollob, Boston, MA (US); Gregory Hinkle, Plymouth, MA (US); Ivanka Toudjarska, Medford, MA (US); David Bumcrot, Belmont, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 225 days.

(21) Appl. No.: 12/635,630

(22) Filed: Dec. 10, 2009

(65) Prior Publication Data
US 2010/0168206 A1    Jul. 1, 2010

Related U.S. Application Data

(60) Provisional application No. 61/121,253, filed on Dec. 10, 2008, provisional application No. 61/185,543, filed on Jun. 9, 2009, provisional application No. 61/244,780, filed on Sep. 22, 2009.

(51) Int. Cl.
*C07H 21/02* (2006.01)
*C07H 21/04* (2006.01)
*C12N 15/58* (2006.01)
*A01N 43/04* (2006.01)
*C12Q 1/68* (2006.01)

(52) U.S. Cl. ....... 536/24.5; 435/6; 435/91.1; 435/91.31; 435/458; 514/44; 536/23.1

(58) Field of Classification Search ............. 435/6, 91.1, 435/455, 91.31, 458; 536/23.1, 24.5; 514/44
See application file for complete search history.

(56) References Cited

U.S. PATENT DOCUMENTS

| | | | |
|---|---|---|---|
| 7,427,605 | B2 | 9/2008 | Davis et al. |
| 7,655,785 | B1* | 2/2010 | Bentwich .................... 536/24.1 |
| 7,718,629 | B2 | 5/2010 | Bumcrot et al. |
| 2003/0143732 | A1 | 7/2003 | Fosnaugh et al. |
| 2003/0170891 | A1 | 9/2003 | McSwiggen |
| 2004/0259247 | A1 | 12/2004 | Tuschl et al. |
| 2006/0263435 | A1 | 11/2006 | Davis et al. |
| 2007/0004664 | A1 | 1/2007 | McSwiggen et al. |
| 2007/0031844 | A1 | 2/2007 | Khvorova et al. |
| 2007/0281899 | A1 | 12/2007 | Bumcrot et al. |
| 2009/0149403 | A1 | 6/2009 | MacLachlan et al. |
| 2010/0120893 | A1* | 5/2010 | Sah et al. ..................... 514/44 A |
| 2010/0240730 | A1* | 9/2010 | Beigelman et al. ......... 514/44 A |
| 2011/0015250 | A1 | 1/2011 | Bumcrot et al. |
| 2011/0070221 | A1* | 3/2011 | Bastian et al. ............. 424/130.1 |

FOREIGN PATENT DOCUMENTS

| | | |
|---|---|---|
| WO | WO 2004/080406 | 9/2004 |
| WO | WO 2004/090108 | 10/2004 |
| WO | WO 2008/098208 A2 | 8/2008 |

OTHER PUBLICATIONS

Examination Report for New Zealand Patent Application No. NZ 593618, Jul. 13, 2011, 3 pages.
Reynolds, et al. (2004) "Rational siRNA design for RNA interference," Nature Biotechnology, vol. 22, No. 3, pp. 326-330.
Robbins, M., et al., "Stable expression of shRNAs in human CD34⁺progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Weil, et al (2002) "Targeting the Kinesin Eg5 to Monitor siRNA Transfection in Mammalian Cells," *Biotechniques* 33(6):1244-1248.
Zimmerman, et al. (2006) "RNAi-mediated gene silencing in non-human primates," *Nature*, vol. 441, May 4: 111-114.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in Drosophila Melanogaster Embryo Lysate", The EMBO Journal, 2001, pp. 6877-6888, vol. 20, No. 23.
Elbashir, S., et al., "RNA Interference is Mediated by 21-and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in Caenorhabditis elegans," Nature, Feb. 19, 1998, pp. 806-811, vol. 391.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation by Double-Stranded RNA in Vitro," Genes & Development, 1999, pp. 3191-3197, vol. 13.
Tuschl, T., "Expanding small RNA interference," Nature Biotechnology, May 2002, pp. 446-448, vol. 20.

(Continued)

*Primary Examiner* — Jane Zara
(74) *Attorney, Agent, or Firm* — Fenwick & West LLP

(57) ABSTRACT

The invention relates to a double-stranded ribonucleic acid (dsRNA) targeting a G-alpha q subunit (GNAQ) of a heterotrimeric G gene, and methods of using the dsRNA to inhibit expression of GNAQ.

36 Claims, 8 Drawing Sheets

OTHER PUBLICATIONS

Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.

PCT International Search Report and Written Opinion, PCT/US2009/067581, May 3, 2010, 20 pages.

PCT Invitation to pay additional fees and, where applicable, protest fees, PCT/US2009/067581, Mar. 12, 2010, 10 pages.

Bamford, S., et al., "The COSMIC (Catalogue of Somatic Mutations in Cancer) database and website," British Journal of Cancer, 2004, vol. 91, pp. 355-358.

Harmon, B., et al., "Induction of the Galpha$_q$ signaling cascade by the human immunodeficiency virus envelope is required for virus entry," Journal of Virology, Sep. 2008, pp. 9191-9205, vol. 82, No. 18.

Roztocil, E., et al., "Sphingosine-1-phosphate-induced oxygen free radical generation in smooth muscle cell migration requires Galpha12/13 protein-mediated phospholipase C activation" Dec. 1, 2007, Journal of Vascular Surgery, pp. 1253-1259, vol. 46, No. 6.

Taboubi, S., et al., "G alpha (q/11)-coupled P2Y(2) nucleotide receptor inhibits human keratinocyte spreading and migration," FASEB Journal, Dec. 2007, pp. 4047-4058, vol. 21, No. 14.

Van Raamsdonk, C.D., et al., "Frequent somatic mutations of GNAQ in uveal melanoma and blue naevi" Nature, Jan. 2009, p. 599-602, vol. 457, No. 7229.

* cited by examiner

GNAQ TARGETED DSRNA COMPOSITIONS AND METHODS FOR INHIBITING EXPRESSION

CROSS REFERENCE TO RELATED APPLICATIONS

This application claims the benefit of U.S. Provisional Application No. 61/121,253, filed Dec. 10, 2008, and U.S. Provisional Application No. 61/185,543, filed Jun. 9, 2009, and U.S. Provisional Application No. 61/244,780, filed Sep. 22, 2009, which are hereby incorporated in their entirety by reference.

REFERENCE TO A SEQUENCE LISTING

This application includes a Sequence Listing submitted electronically as a text file named 16267US_sequencelisting.txt, created on Dec. 10, 2010, with a size of 560,474 bytes. The sequence listing is incorporated by reference.

FIELD OF THE INVENTION

The invention relates to a double-stranded ribonucleic acid (dsRNA) targeting a G-alpha q subunit (GNAQ) of a heterotrimeric G gene, and methods of using the dsRNA to inhibit expression of GNAQ.

BACKGROUND OF THE INVENTION

Guanine nucleotide-binding proteins (G proteins) are a family of heterotrimeric proteins that couple cell surface, 7-transmembrane domain receptors to intracellular signaling pathways. G proteins are composed of alpha, beta and gamma subunits. The G-alpha q subunit (GNAQ) is one of the G-alpha subunits. GNAQ mediates stimulation of phospholipase C-beta and hydrolysis of GTP.

Mice with GNAQ mutations leading to overexpression of GNAQ exhibit dermal hyperpigmentation. A point mutation in human GNAQ was reported in a melanoma sample (Bamford et al (2004) Br J Cancer, 91:355-358). In WO/2008/098208 (PCT/US2008/053484), the Applicant's described the presence of mutations that constitutively activate GNAQ in melanocytic neoplasms, e.g., uveal melanomas.

Double-stranded RNA molecules (dsRNA) have been shown to block gene expression in a highly conserved regulatory mechanism known as RNA interference (RNAi). WO 99/32619 (Fire et al.) disclosed the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.).

SUMMARY OF THE INVENTION

Disclosed herein are dsRNAs targeted to GNAQ for inhibiting expression of GNAQ in a cell. Also disclosed are methods of using the GNAQ dsRNA for siRNA inhibition of GNAQ expression and treatment of disease associated with expression and/or over expression of GNAQ, e.g., uveal melanoma.

Accordingly one aspect of the invention is a double-stranded ribonucleic acid (dsRNA) for inhibiting expression of a G-alpha q subunit (GNAQ) of a heterotrimeric G gene, having a sense strand and an antisense strand having a region of complementarity complementary to an mRNA encoding GNAQ, wherein each strand is at least 15 nucleotides in length. In one embodiment the dsRNA is AD-20057, e.g., sense strand is SEQ ID NO:1579 and the antisense strand is SEQ ID NO:1580. In another embodiment, the antisense strand is complementary to at least 15 contiguous nucleotides of SEQ ID NO:1421 or is complementary to at least the first 11 nucleotides of SEQ ID NO:1421. The sense strand can include 15 or more contiguous nucleotides of SEQ ID NO:1421 or SEQ ID NO:1579 and/or the antisense strand can include 15 or more contiguous nucleotides of SEQ ID NO:1422 or SEQ ID NO:1580. In some embodiments the sense strand nucleotide sequence includes SEQ ID NO:1421 and the antisense strand nucleotide sequence includes SEQ ID NO:1422.

In some embodiments the dsRNA of the invention results in the following: administration of 0.1 nM of the dsRNA to a A375 cell results in about 66% inhibition of GNAQ mRNA expression as measured by a real time PCR assay or administration of 1 nM of the dsRNA to a A375 cell results in about 61% inhibition of GNAQ mRNA expression as measured by a real time PCR assay or administration of 1 nM of the dsRNA to a A579 cell results in about 82% inhibition of GNAQ mRNA expression as measured by a real time PCR assay or administration of 10 nM of the dsRNA to a OMM1.3 cell results in about 42% inhibition of GNAQ mRNA expression as measured by a real time PCR assay or administration of the dsRNA to a UMEL202 cell results in about 81% inhibition of GNAQ mRNA expression as measured by a real time PCR assay.

In another embodiment, the dsRNA is AD-20051 and the sense strand is SEQ ID NO:1565 and the antisense strand is SEQ ID NO:1566. The dsRNA can be complementary to at least the first 11 nucleotides of SEQ ID NO:1407 and/or complementary to at least 15 contiguous nucleotides of SEQ ID NO:1407. In some embodiments the sense strand includes 15 or more contiguous nucleotides of SEQ ID NO: 1407 or SEQ ID NO:1565 and/or the antisense strand includes 15 or more contiguous nucleotides of SEQ ID NO:1408 or SEQ ID NO:1566. The sense strand nucleotide sequence can include SEQ ID NO:1407 and the antisense strand nucleotide sequence can include SEQ ID NO:1408.

In some embodiments the dsRNA of the invention results in the following: administration of 0.1 nM of the dsRNA to a A375 cell results in about 49% inhibition of GNAQ mRNA expression as measured by a real time PCR assay or administration of 1 nM of the dsRNA to a A375 cell results in about 55% inhibition of GNAQ mRNA expression as measured by a real time PCR assay or administration of 1 nM of the dsRNA to a A579 cell results in about 83% inhibition of GNAQ mRNA expression as measured by a real time PCR assay or administration of 10 nM of the dsRNA to a OMM1.3 cell results in about 42% inhibition of GNAQ mRNA expression as measured by a real time PCR assay.

In other embodiments the dsRNA is AD-20052 or AD-20069.

The antisense strand of the dsRNA is partially or completely complementary to an mRNA encoding a GNAQ, e.g., to a human GNAQ mRNA (e.g., NM_002072) or to a rat GNAQ mRNA (e.g., NM_031036). The region complementary is at least 15 nucleotides in length, e.g., between 19 and 21 nucleotides in length, e.g., 19 nucleotides in length. The region of complementarity can include at least 15 contiguous nucleotides of one of the antisense sequences listed in Tables 2a, 3a, or 4a. In other embodiments, the region of complementarity is one of the antisense sequences listed in Tables 2a, 3a, or 4a.

Additional exemplary dsRNA are provided in the tables herein. In some embodiments, the dsRNA of the invention includes a sense strand and antisense strand are selected from Tables 2b, 3b, 4b or Tables 2c, 3c, or 4c or Tables 2d, 3d, or 4d.

In one aspect, each strand of the dsRNA is no more than 30 nucleotides in length. At least one strand can include a 3' overhang of at least 1 nucleotide, e.g., 2 nucleotides, e.g., dTdT.

In some embodiments, the dsRNA is modified. For example, the dsRNA can include a modification that causes the dsRNA to have increased stability in a biological sample. In one embodiment, the dsRNA includes at least one modified nucleotide, e.g., a 2'-O-methyl modified nucleotide, a nucleotide comprising a 5'-phosphorothioate group, or a terminal nucleotide linked to a cholesteryl derivative or dodecanoic acid bisdecylamide group. In other embodiments the modified nucleotide is a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, or a non-natural base comprising nucleotide. The dsRNA of the invention can include at least one 2'-O-methyl modified nucleotide and at least one 2'-deoxythymidine-3'-phosphate nucleotide comprising a 5'-phosphorothioate group.

Any of the dsRNA of the invention can be modified according to a set of rules, e.g., the sense strand includes all 2'-O-methyl modified pyrimidines and the antisense strand comprises 2'-O-methyl modified pyrimidines when the pyrimidine is adjacent to A and each strand comprises dTdT at the 3' end or the sense strand comprises all 2'-O-methyl modified pyrimidines and the antisense strand comprises 2'-O-methyl modified pyrimidines when the pyrimidine is adjacent to A and each strand comprises dTsdT at the 3' end or the sense strand comprises all 2'-O-methyl modified pyrimidines and the antisense strand comprises 2'-O-methyl modified pyrimidines when a) the pyrimidine is adjacent to A or b) the pyrimidine is a uracil adjacent to a U or a G, and each strand comprises dTsdT at the 3' end.

In some embodiments the dsRNA include a ligand. The ligand can be conjugated to the 3'-end of the sense strand of the dsRNA.

Another aspect of the invention is a composition for inhibiting expression of a GNAQ gene including a dsRNA targeting GNAQ and a pharmaceutical formulation. In one embodiment, the pharmaceutical formulation is a lipid formulation. Exemplary formulations are described herein and include, for example, a LNP formulation, a LNP01 formulation, a XTC-SNALP formulation, a SNALP formulation, or a LNP11 formulation.

Also included herein is an isolated cell containing a dsRNA of the invention, a vector including the nucleotide sequence that encodes at least one strand of the dsRNA of the invention, and a cell including said vector.

A dsRNA of the invention, upon contact with a cell expressing said GNAQ, inhibits expression of said GNAQ gene by at least 40% compared to a cell not so contacted. In some embodiments, a dsRNA of the invention has a pM IC50, e.g., an IC50 of less than 10 pM.

Another aspect of the invention is method of inhibiting GNAQ expression in a cell, the method including introducing into the cell any of the dsRNA of the invention and maintaining the cell for a time sufficient to obtain degradation of the mRNA transcript of a GNAQ gene, thereby inhibiting expression of the GNAQ gene in the cell. In some embodiments, expression is inhibited by at least 20%, 40%, 60%, or at least 80%. Also included is a method of treating a disorder mediated by GNAQ expression by administering to a human in need of such treatment a therapeutically effective amount of any of the dsRNA of the invention. Examples of said disorders include uveal melanoma, cutaneous melanoma, Blue nevi, Nevi of Ota, a small lung tumor, or a neuroendocrine tumors. The method of treatment can include administering an addition composition, e.g., a second dsRNA.

DETAILED DESCRIPTION OF THE INVENTION

Figure 1:
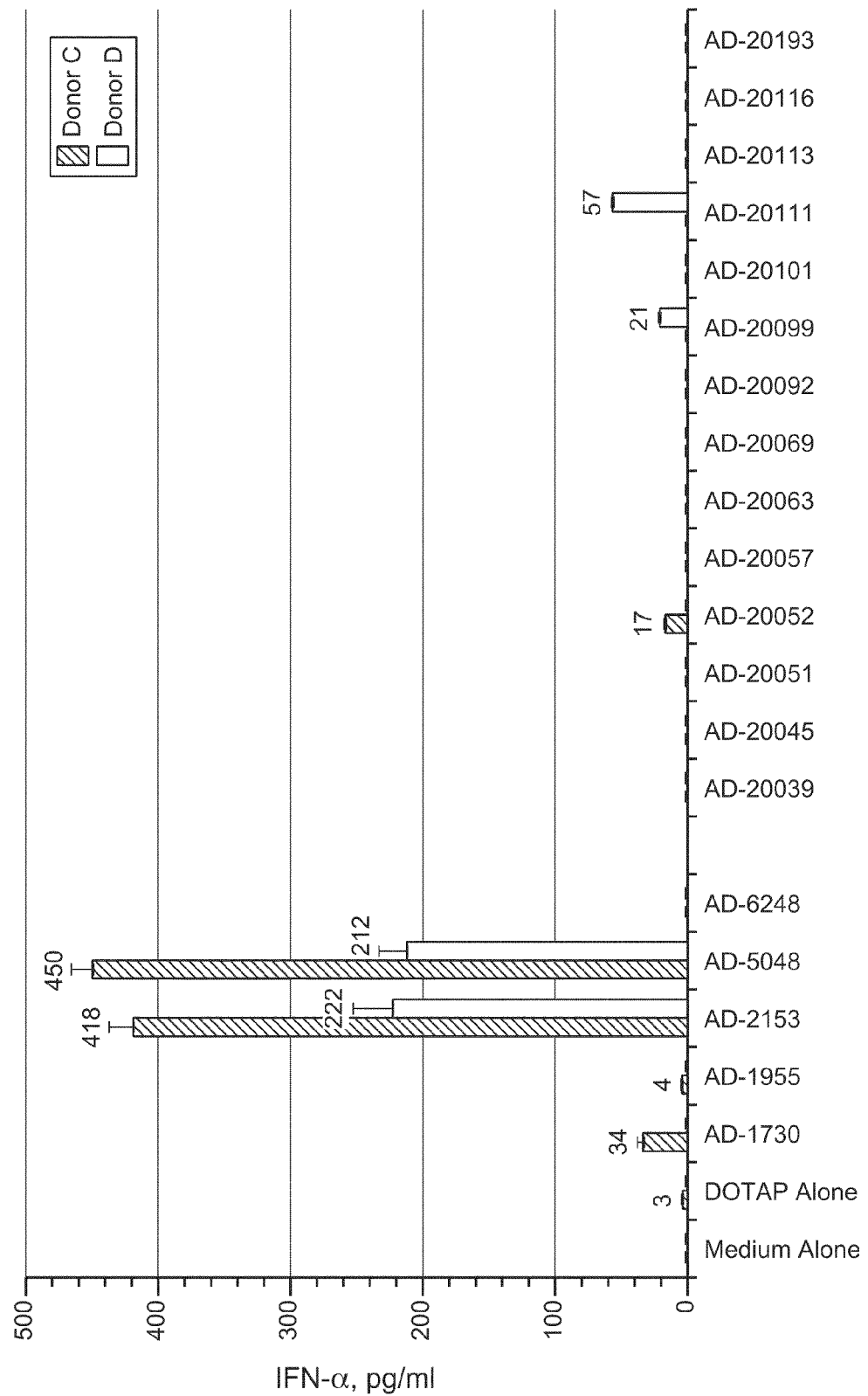
FIG. 1 is a graph showing IFN-alpha cytokine induction in human PBMCs following transfection with a set of GNAQ targeted dsRNA.

The invention provides dsRNAs and methods of using the dsRNAs for inhibiting the expression of a G-alpha q subunit (GNAQ) of a heterotrimeric G gene in a cell or a mammal where the dsRNA targets a GNAQ gene. The invention also provides compositions and methods for treating pathological conditions and diseases, such as uveal melanoma in a mammal caused by the over-expression of a GNAQ gene. A dsRNA directs the sequence-specific degradation of mRNA through a process known as RNA interference (RNAi).

The dsRNAs of the compositions featured herein include an antisense strand having a region which is less than 30 nucleotides in length, generally 19-24 nucleotides in length, and is complementary to at least part of an mRNA transcript of a GNAQ gene. The use of these dsRNAs enables the targeted degradation of mRNAs of genes that are implicated in pathologies associated with GNAQ expression in mammals. Very low dosages of GNAQ dsRNAs in particular can specifically and efficiently mediate RNAi, resulting in significant inhibition of expression of a GNAQ gene. Using cell-based assays, the present inventors demonstrate that dsRNAs targeting GNAQ can specifically and efficiently mediate RNAi, resulting in significant inhibition of expression of a GNAQ gene. Thus, methods and compositions including these dsRNAs are useful for treating pathological processes that can be mediated by down regulating GNAQ over-expression, such as, e.g., treatment of uveal melanoma.

The following detailed description discloses how to make and use the compositions containing dsRNAs to inhibit the expression of a GNAQ gene, as well as compositions (e.g., pharmaceutical compositions) and methods for treating diseases and disorders caused by the expression of this gene.

Accordingly, in some aspects, pharmaceutical compositions containing a GNAQ dsRNA and a pharmaceutically acceptable carrier, methods of using the compositions to inhibit expression of a GNAQ gene, and methods of using the pharmaceutical compositions to treat diseases caused by expression of a GNAQ gene are featured in the invention.

Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine. However, it will be understood that the term "ribonucleotide" or "nucleotide" or "deoxyribonucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "GNAQ" refers to a G-alpha q subunit (GNAQ) of a heterotrimeric G gene. GNAQ is also known as guanine nucleotide binding protein (G protein), q polypeptide and G-ALPHA-q, GAQ. The sequence of a human GNAQ mRNA transcript can be found at NM_002072.2. The sequence of rat GNAQ mRNA can be found at NM_031036.

A used herein "target" or "target gene" refers to a GNAQ gene.

As used herein, "target sequence" refers to a contiguous portion of the nucleotide sequence of an mRNA molecule formed during the transcription of a GNAQ gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., a target gene, e.g., an mRNA encoding GNAQ) including a 5' UTR, an open reading frame (ORF), or a 3' UTR. For example, a polynucleotide is complementary to at least a part of a GNAQ mRNA if the sequence is substantially complementary to a non-interrupted portion of an mRNA encoding GNAQ.

The term "double-stranded RNA" or "dsRNA," as used herein, refers to a complex of ribonucleic acid molecules, having a duplex structure comprising two anti-parallel and substantially complementary, as defined above, nucleic acid strands. In general, the majority of nucleotides of each strand are ribonucleotides, but as described in detail herein, each or both strands can also include at least one non-ribonucleotide, e.g., a deoxyribonucleotide and/or a modified nucleotide. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. The term "siRNA" is also used herein to refer to a dsRNA as described above.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

As used herein, the term "SNALP" refers to a stable nucleic acid-lipid particle. A SNALP represents a vesicle of lipids coating a reduced aqueous interior comprising a nucleic acid such as an iRNA agent or a plasmid from which an iRNA agent is transcribed. SNALP are described, e.g., in U.S. Patent Application Publication Nos. 20060240093, 20070135372, and U.S. Ser. No. 61/045,228 filed on Apr. 15, 2008. These applications are hereby incorporated by reference.

"Introducing into a cell," when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell," wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence," "inhibit the expression of," "downregulate the expression of," "suppress the expression of" and the like, in as far as they refer to a target gene, herein refer to the at least partial suppression of the expression of a GNAQ gene, as manifested by a reduction of the amount of mRNA which may be isolated or detected from a first cell or group of cells in which a GNAQ gene is transcribed and which has or have been treated such that the expression of a GNAQ gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to GNAQ gene transcription, e.g., the amount of protein encoded by a GNAQ gene which is secreted by a cell, or the number of cells displaying a certain phenotype, e.g., apoptosis. In principle, GNAQ gene silencing may be determined in any cell expressing the target, either constitutively or by genomic engineering, and by any appropriate assay. However, when a reference is needed in order to determine whether a given dsRNA inhibits the expression of a GNAQ gene by a certain degree and therefore is encompassed by the instant invention, the assays provided in the Examples below shall serve as such reference.

For example, in certain instances, expression of a GNAQ gene is suppressed by at least about 5%, 10%, 15%, 20%, 25%, 30%, 35%, 40%, 45%, or 50% by administration of the double-stranded oligonucleotide featured in the invention. In some embodiments, a GNAQ gene is suppressed by at least about 60%, 70%, or 80% by administration of the double-stranded oligonucleotide featured in the invention. In some embodiments, a GNAQ gene is suppressed by at least about 85%, 90%, or 95% by administration of the double-stranded oligonucleotide featured in the invention.

As used herein in the context of GNAQ expression, the terms "treat," "treatment," and the like, refer to relief from or alleviation of pathological processes mediated by GNAQ expression. In the context of the present invention insofar as it relates to any of the other conditions recited herein below (other than pathological processes mediated by GNAQ expression), the terms "treat," "treatment," and the like mean to relieve or alleviate at least one symptom associated with such condition, or to slow or reverse the progression of such condition, such as tumor reduction in uveal melanoma.

As used herein, the phrases "therapeutically effective amount" and "prophylactically effective amount" refer to an amount that provides a therapeutic benefit in the treatment, prevention, or management of pathological processes mediated by GNAQ expression or an overt symptom of pathological processes mediated by GNAQ expression. The specific amount that is therapeutically effective can be readily determined by an ordinary medical practitioner, and may vary depending on factors known in the art, such as, for example, the type of pathological processes mediated by GNAQ expression, the patient's history and age, the stage of pathological processes mediated by GNAQ expression, and the administration of other anti-pathological processes mediated by GNAQ expression agents.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

Double-stranded ribonucleic acid (dsRNA)

As described in more detail herein, the invention provides double-stranded ribonucleic acid (dsRNA) molecules for inhibiting the expression of a GNAQ gene in a cell or mammal, where the dsRNA includes a sense strand having a first sequence and an antisense strand comprising a second sequence complementary to mRNA encoding GNAQ, wherein said first sequence is complementary to said second sequence at a region of complementarity and wherein each strand is 15 to 30 base pairs in length. In some embodiments, the dsRNA of the invention inhibits the expression of said GNAQ gene by at least 40% as assayed by, for example, a PCR or branched DNA (bDNA)-based method, or by a protein-based method, such as by Western blot. Expression of a GNAQ gene can be reduced by at least 30% when measured by an assay as described in the Examples below. For example, expression of a GNAQ gene in cell culture, such as in HepB3 cells, can be assayed by measuring GNAQ mRNA levels, such as by bDNA or TaqMan assay, or by measuring protein levels, such as by ELISA assay.

The dsRNA can be synthesized by standard methods known in the art as further discussed below, e.g., by use of an automated DNA synthesizer, such as are commercially available from, for example, Biosearch, Applied Biosystems, Inc. The dsRNA includes two RNA strands that are sufficiently complementary to hybridize to form a duplex structure.

One strand of the dsRNA (the antisense strand) includes a region of complementarity that is complementary, to a target sequence, derived from the sequence of an mRNA formed during the expression of a target gene, the other strand (the sense strand) includes a region that is complementary to the antisense strand, such that the two strands hybridize and form a duplex structure when combined under suitable conditions. The region of complementarity is generally at least 15 nucleotides in length, or between 19 and 21 nucleotides in length, or 19, 20, or 21 nucleotides in length. In some embodiments the region of complementarity includes at least 15 contiguous nucleotides of one of the antisense sequences listed in Tables 2a, 3a, or 4a. In other embodiments the region of complementarity includes one of the antisense sequences listed in Tables 2a, 3a, or 4a.

Generally, the duplex structure is between 15 and 30, or between 25 and 30, or between 18 and 25, or between 19 and 24, or between 19 and 21, or 19, 20, or 21 base pairs in length. In one embodiment the duplex is 19 base pairs in length. In another embodiment the duplex is 21 base pairs in length. When two different dsRNAs are used in combination, the duplex lengths can be identical or can differ.

Each strand of the dsRNA of invention is generally between 15 and 30, or between 18 and 25, or 18, 19, 20, 21, 22, 23, 24, or 25 nucleotides in length. In other embodiments, each is strand is 25-30 nucleotides in length. Each strand of the duplex can be the same length or of different lengths. When two different siRNAs are used in combination, the lengths of each strand of each siRNA can be identical or can differ.

The dsRNA of the invention can include one or more single-stranded overhang(s) of one or more nucleotides. In one embodiment, at least one end of the dsRNA has a single-stranded nucleotide overhang of 1 to 4, or 1, 2, 3, or 4 nucleotides. In another embodiment, the overhang include dTdT. In another embodiment, the antisense strand of the dsRNA has 1-10 nucleotides overhangs each at the 3' end and the 5' end over the sense strand. In further embodiments, the sense strand of the dsRNA has 1-10 nucleotides overhangs each at the 3' end and the 5' end over the antisense strand.

A dsRNAs having at least one nucleotide overhang can have unexpectedly superior inhibitory properties than the blunt-ended counterpart. In some embodiments the presence of only one nucleotide overhang strengthens the interference activity of the dsRNA, without affecting its overall stability. A dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA can also have a blunt end, generally located at the 5'-end of the antisense strand. Such dsRNAs can have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

In one embodiment, a GNAQ gene is a human GNAQ gene, e.g., the sequence identified by GenBank accession number NM_002072.2.

In specific embodiments, the sense strand of the dsRNA is one of the a sense sequences from Tables 2-4, and the antisense strand is one of the antisense sequences of Tables 2-4. Alternative antisense agents that target elsewhere in the target sequence provided in Tables 2-4 can readily be determined using the target sequence and the flanking GNAQ sequence.

The skilled person is well aware that dsRNAs having a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Tables 2-4, the dsRNAs featured in the invention can include at least one strand of a length described therein. It can be reasonably expected that shorter dsRNAs having one of the sequences of Tables 2-4 minus only a few nucleotides on one or both ends may be similarly effective as compared to the dsRNAs described above. Hence, dsRNAs having a partial sequence of at least 15, 16, 17, 18, 19, 20, 21, or 22, or more contiguous nucleotides from one of the sequences of Tables 2-4, and differing in their ability to inhibit the expression of a GNAQ gene in an assay as described herein below by not more than 5, 10, 15, 20, 25, or 30% inhibition from a dsRNA comprising the full sequence, are contemplated by the invention. Further, dsRNAs that cleave within a desired GNAQ target sequence can readily be made using the corresponding GNAQ antisense sequence and a complementary sense sequence.

In addition, the dsRNAs provided in Tables 2-4 identify a site in a GNAQ that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Tables 2-4 coupled to additional nucleotide sequences taken from the region contiguous to the selected sequence in a GNAQ gene.

Additional dsRNA of the invention include those that cleave a target mRNA at the same location as a dsRNA described in any of the tables. In general, a RISC complex will cleave a target mRNA between the nucleotides complementary to nucleotides 10 and 11 of the antisense strand of a dsRNA, e.g., siRNA, of the invention. Cleavage e sites can be assayed using, e.g., a 5' RACE assay.

For example, the duplex AD-20057 includes the sense and antisense strands below. Treatment of a cell with this duplex results in cleavage of human GNAQ mRNA at the nucleotides complementary to nucleotides 10 and 11 of the antisense strand, e.g., nucleotides 1211 and 1212. Therefore, also included in the invention are those dsRNA that cleave at that location.

The dsRNA featured in the invention can contain one or more mismatches to the target sequence. In one embodiment, the dsRNA featured in the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of a target gene, the dsRNA generally does not contain any mismatch within the central 13 nucleotides. The methods described within the invention can be used to determine whether a dsRNA containing a mismatch to a target sequence is effective in inhibiting the expression of a target gene. Consideration of the efficacy of dsRNAs with mismatches in inhibiting expression of a target gene is important, especially if the particular region of complementarity in a target gene is known to have polymorphic sequence variation within the population.

Modifications

In yet another embodiment, the dsRNA is chemically modified to enhance stability. The nucleic acids featured in the invention may be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Specific examples of dsRNA compounds useful in this invention include dsRNAs containing modified backbones or no natural internucleoside linkages. As defined in this specification, dsRNAs having modified backbones include those that retain a phosphorus atom in the backbone and those that do not have a phosphorus atom in the backbone. For the purposes of this specification, and as sometimes referenced in the art, modified dsRNAs that do not have a phosphorus atom in their internucleoside backbone can also be considered to be oligonucleosides.

Modified dsRNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; and 5,625,050, each of which is herein incorporated by reference Modified dsRNA backbones that do not include a phosphorus atom therein have backbones that are formed by short chain alkyl or cycloalkyl internucleoside linkages, mixed heteroatoms and alkyl or cycloalkyl internucleoside linkages, or ore or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other suitable dsRNA mimetics, both the sugar and the internucleoside linkage, i.e., the backbone, of the nucleotide units are replaced with novel groups. The base units are maintained for hybridization with an appropriate nucleic acid target compound. One such oligomeric compound, a dsRNA mimetic that has been shown to have excellent hybridization properties, is referred to as a peptide nucleic acid (PNA). In PNA compounds, the sugar backbone of a dsRNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500. Other embodiments of the invention are dsRNAs with phosphorothioate backbones and oligonucleosides with heteroatom backbones, and in particular —CH2-NH—CH2-, —CH2-N(CH3)-O—CH2- [known as a methylene (methylimino) or MMI backbone], —CH2-O—N(CH3)-CH2-, —CH2-N(CH3)-N(CH3)-CH2- and —N(CH3)-CH2-CH2- [wherein the native phosphodiester backbone is represented as —O—P—O—CH2-] of the above-referenced U.S. Pat. No. 5,489,677, and the amide backbones of the above-referenced U.S. Pat. No. 5,602,240. Also preferred are dsRNAs having morpholino backbone structures of the above-referenced U.S. Pat. No. 5,034,506.

Modified dsRNAs may also contain one or more substituted sugar moieties. Preferred dsRNAs comprise one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted C1 to C10 alkyl or C2 to C10 alkenyl and alkynyl. Particularly preferred are O[(CH2)nO]mCH3, O(CH2)nOCH3, O(CH2)nNH2, O(CH2)nCH3, O(CH2) nONH2, and O(CH2)nON[(CH2)nCH3)]2, where n and m are from 1 to about 10. Other preferred dsRNAs comprise one of the following at the 2' position: C1 to C10 lower alkyl, substituted lower alkyl, alkaryl, aralkyl, O-alkaryl or O-aralkyl, SH, SCH3, OCN, Cl, Br, CN, CF3, OCF3, SOCH3, SO2CH3, ONO2, NO2, N3, NH2, heterocycloalkyl, heterocycloalkaryl, aminoalkylamino, polyalkylamino, substituted silyl, an RNA cleaving group, a reporter group, an intercalator, a group for improving the pharmacokinetic properties of an dsRNA, or a group for improving the pharmacodynamic properties of an dsRNA, and other substituents having similar properties. A preferred modification includes 2'-methoxyethoxy (2'-O—CH2CH2OCH3, also known as 2'-O-(2-methoxyethyl) or 2'-MOE) (Martin et al., Helv. Chim. Acta, 1995, 78, 486-504) i.e., an alkoxy-alkoxy group. A further preferred modification includes 2'-dimethylaminooxyethoxy, i.e., a O(CH2)2ON(CH3)2 group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH2-O—CH2-N(CH2)2, also described in examples herein below.

Other preferred modifications include 2'-methoxy (2'-OCH3), 2'-aminopropoxy (2'-OCH$_2$CH$_2$CH$_2$NH$_2$) and 2'-fluoro (2'-F). Similar modifications may also be made at other positions on the dsRNA, particularly the 3' position of the sugar on the 3' terminal nucleotide or in 2'-5' linked dsRNAs and the 5' position of 5' terminal nucleotide. DsRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

A dsRNA may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. L., ed. John Wiley & Sons, 1990, these disclosed by Englisch et al., Angewandte Chemie, International Edition, 1991, 30, 613, and those disclosed by Sanghvi, Y S., Chapter 15, DsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., DsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; and 5,681,941, each of which is herein incorporated by reference, and U.S. Pat. No. 5,750,692, also herein incorporated by reference.

Conjugates

Another modification of the dsRNAs featured in the invention involves chemically linking to the dsRNA one or more moieties or conjugates which enhance the activity, cellular distribution or cellular uptake of the dsRNA. Such moieties include but are not limited to lipid moieties such as a cholesterol moiety (Letsinger et al., Proc. Natl. Acad. Sci. USA, 1989, 86: 6553-6556), cholic acid (Manoharan et al., Biorg. Med. Chem. Let., 1994, 4:1053-1060), a thioether, e.g., beryl-S-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethyl-ammonium 1,2-di-O-hexadecyl-rac-glycero-3H-phosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylamino-carbonyloxycholesterol moiety (Crooke et al., J. Pharmacol. Exp. Ther., 1996, 277:923-937).

Representative U.S. patents that teach the preparation of such dsRNA conjugates include, but are not limited to, U.S. Pat. Nos. 4,828,979; 4,948,882; 5,218,105; 5,525,465; 5,541, 313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within a dsRNA. The present invention also includes dsRNA compounds which are chimeric compounds. "Chimeric" dsRNA compounds or "chimeras," in the context of this invention, are dsRNA compounds, particularly dsRNAs, which contain two or more chemically distinct regions, each made up of at least one monomer unit, i.e., a nucleotide in the case of a dsRNA compound. These dsRNAs typically contain at least one region wherein the dsRNA is modified so as to confer upon the dsRNA increased resistance to nuclease degradation, increased cellular uptake, and/or increased binding affinity for the target nucleic acid. An additional region of the dsRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of dsRNA inhibition of gene expression. Consequently, comparable results can often be obtained with shorter dsRNAs when chimeric dsRNAs are used, compared to phosphorothioate deoxydsRNAs hybridizing to the same target region. Cleavage of the RNA target can be routinely detected by gel electrophoresis and, if necessary, associated nucleic acid hybridization techniques known in the art.

In certain instances, the dsRNA may be modified by a non-ligand group. A number of non-ligand molecules have been conjugated to dsRNAs in order to enhance the activity, cellular distribution or cellular uptake of the dsRNA, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such dsRNA conjugates have been listed above. Typical conjugation protocols involve the synthesis of dsRNAs bearing an aminolinker at one or more positions of the sequence. The amino group is then reacted with the molecule being conjugated using appropriate coupling or activating reagents. The conjugation reaction may be performed either with the dsRNA still bound to the solid support or following cleavage of the dsRNA in solution phase. Purification of the dsRNA conjugate by HPLC typically affords the pure conjugate.

Vector encoded dsRNAs

In another aspect, dsRNA molecules of the invention are expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., Proc. Natl. Acad. Sci. USA (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In one embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., Curr. Topics Micro. Immunol. (1992) 158:97-129)); adenovirus (see, for example, Berkner, et al., BioTechniques (1998) 6:616), Rosenfeld et al. (1991, Science 252:431-434), and Rosenfeld et al. (1992), Cell 68:143-155)); or alphavirus as well as others known in the art. Retroviruses have been used to introduce a variety of genes into many different cell types, including epithelial cells, in vitro and/or in vivo (see, e.g., Eglitis, et al., Science (1985) 230:1395-1398; Danos and Mulligan, Proc. Natl. Acad. Sci. USA (1998) 85:6460-6464; Wilson et al., 1988, Proc. Natl. Acad. Sci. USA 85:3014-3018; Armentano et al., 1990, Proc. Natl. Acad. Sci. USA 87:61416145; Huber et al., 1991, Proc. Natl. Acad. Sci. USA 88:8039-8043; Ferry et al., 1991, Proc. Natl. Acad. Sci. USA 88:8377-8381; Chowdhury et al., 1991, Science 254:1802-1805; van Beusechem. et al., 1992, Proc. Nad. Acad. Sci. USA 89:7640-19; Kay et al., 1992, Human Gene Therapy 3:641-647; Dai et al., 1992, Proc. Natl. Acad. Sci. USA 89:10892-10895; Hwu et al., 1993, J. Immunol. 150:4104-4115; U.S. Pat. Nos. 4,868,116; 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, Human Gene Therapy 2:5-10; Cone et al., 1984, Proc. Natl. Acad. Sci. USA 81:6349). Recombinant adenoviral vectors can be used to infect a wide variety of cells and tissues in susceptible hosts (e.g., rat, hamster, dog, and chimpanzee) (Hsu et al., 1992, J. Infectious Disease, 166:769), and also have the advantage of not requiring mitotically active cells for infection.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors featured in the invention can be pseudotyped with surface proteins from vesicular stomatitis virus (VSV), rabies, Ebola, Mokola, and the like. AAV vectors featured in the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392: 25-30; and Rubinson D A et al., Nat. Genet. 33: 401-406, the entire disclosures of which are herein incorporated by reference.

Viral vectors can be derived from AV and AAV. In one embodiment, the dsRNA featured in the invention is expressed as two separate, complementary single-stranded RNA molecules from a recombinant AAV vector having, for example, either the U6 or H1 RNA promoters, or the cytomegalovirus (CMV) promoter.

A suitable AV vector for expressing the dsRNA featured in the invention, a method for constructing the recombinant AV vector, and a method for delivering the vector into target cells, are described in Xia H et al. (2002), *Nat. Biotech.* 20: 1006-1010.

Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

The promoter driving dsRNA expression in either a DNA plasmid or viral vector featured in the invention may be a eukaryotic RNA polymerase I (e.g., ribosomal RNA promoter), RNA polymerase II (e.g., CMV early promoter or actin promoter or U1 snRNA promoter) or generally RNA polymerase III promoter (e.g., U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g., the insulin regulatory sequence for pancreas (Bucchini et al., 1986, Proc. Natl. Acad. Sci. USA 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g., Oligofectamine) or non-cationic lipid-based carriers (e.g., Transit-TKO™). Multiple lipid transfections for dsRNA-mediated knockdowns targeting different regions of a single target gene or multiple target genes over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Target gene specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Pharmaceutical compositions containing dsRNA

In one embodiment, the invention provides pharmaceutical compositions containing a dsRNA, as described herein, and a pharmaceutically acceptable carrier. The pharmaceutical composition containing the dsRNA is useful for treating a disease or disorder associated with the expression or activity of a GNAQ gene, such as pathological processes mediated by GNAQ expression. Such pharmaceutical compositions are formulated based on the mode of delivery. One example is compositions that are formulated for systemic administration via parenteral delivery, e.g., by intravenous (IV) delivery. Another example is compositions that are formulated for direct delivery into the brain parenchyma, e.g., by infusion into the brain, such as by continuous pump infusion.

The pharmaceutical compositions featured herein are administered in dosages sufficient to inhibit expression of GNAQ genes. In general, a suitable dose of dsRNA will be in the range of 0.01 to 200.0 milligrams siRNA per kilogram body weight of the recipient per day, generally in the range of 1 to 50 mg per kilogram body weight per day. For example, the dsRNA can be administered at 0.0059 mg/kg, 0.01 mg/kg, 0.0295 mg/kg, 0.05 mg/kg, 0.0590 mg/kg, 0.163 mg/kg, 0.2 mg/kg, 0.3 mg/kg, 0.4 mg/kg, 0.5 mg/kg, 0.543 mg/kg, 0.5900 mg/kg, 0.6 mg/kg, 0.7 mg/kg, 0.8 mg/kg, 0.9 mg/kg, 1 mg/kg, 1.1 mg/kg, 1.2 mg/kg, 1.3 mg/kg, 1.4 mg/kg, 1.5 mg/kg, 1.628 mg/kg, 2 mg/kg, 3 mg/kg, 5.0 mg/kg, 10 mg/kg, 20 mg/kg, 30 mg/kg, 40 mg/kg, or 50 mg/kg per single dose.

In one embodiment, the dosage is between 0.01 and 0.2 mg/kg. For example, the dsRNA can be administered at a dose of 0.01 mg/kg, 0.02 mg/kg, 0.03 mg/kg, 0.04 mg/kg, 0.05 mg/kg, 0.06 mg/kg, 0.07 mg/kg 0.08 mg/kg 0.09 mg/kg, 0.10 mg/kg, 0.11 mg/kg, 0.12 mg/kg, 0.13 mg/kg, 0.14 mg/kg, 0.15 mg/kg, 0.16 mg/kg, 0.17 mg/kg, 0.18 mg/kg, 0.19 mg/kg, or 0.20 mg/kg.

In one embodiment, the dosage is between 0.005 mg/kg and 1.628 mg/kg. For example, the dsRNA can be administered at a dose of 0.0059 mg/kg, 0.0295 mg/kg, 0.0590 mg/kg, 0.163 mg/kg, 0.543 mg/kg, 0.5900 mg/kg, or 1.628 mg/kg.

In one embodiment, the dosage is between 0.2 mg/kg and 1.5 mg/kg. For example, the dsRNA can be administered at a dose of 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1 mg/kg, 1.1 mg/kg, 1.2 mg/kg, 1.3 mg/kg, 1.4 mg/kg, or 1.5 mg/kg.

The dsRNA can be administered at a dose of 0.03 mg/kg.

The pharmaceutical composition may be administered once daily, or the dsRNA may be administered as two, three, or more sub-doses at appropriate intervals throughout the day or even using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The effect of a single dose on GNAQ levels is long lasting, such that subsequent doses are administered at not more than 3, 4, or 5 day intervals, or at not more than 1, 2, 3, or 4 week intervals, or at not more than 5, 6, 7, 8, 9, or 10 week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by GNAQ expression. Such models are used for in vivo testing of dsRNA, as well as for determining a therapeutically effective dose. A suitable mouse model is, for example, a mouse containing a plasmid expressing human GNAQ. Another suitable mouse model is a transgenic mouse carrying a transgene that expresses human GNAQ.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

The dsRNAs featured in the invention can be administered in combination with other known agents effective in treatment of pathological processes mediated by target gene expression. In any event, the administering physician can adjust the amount and timing of dsRNA administration on the basis of results observed using standard measures of efficacy known in the art or described herein.

Administration

The present invention also includes pharmaceutical compositions and formulations which include the dsRNA compounds featured in the invention. The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; or intracranial, e.g., intraparenchymal, intrathecal or intraventricular, administration.

The dsRNA can be delivered in a manner to target a particular tissue, such as the liver (e.g., the hepatocytes of the liver).

The present invention includes pharmaceutical compositions that can be delivered by injection directly into the brain. The injection can be by stereotactic injection into a particular region of the brain (e.g., the substantia nigra, cortex, hippocampus, striatum, or globus pallidus), or the dsRNA can be delivered into multiple regions of the central nervous system (e.g., into multiple regions of the brain, and/or into the spinal cord). The dsRNA can also be delivered into diffuse regions of the brain (e.g., diffuse delivery to the cortex of the brain).

In one embodiment, a dsRNA targeting GNAQ can be delivered by way of a cannula or other delivery device having one end implanted in a tissue, e.g., the brain, e.g., the substantia nigra, cortex, hippocampus, striatum, corpus callosum or globus pallidus of the brain. The cannula can be connected to a reservoir of the dsRNA composition. The flow or delivery can be mediated by a pump, e.g., an osmotic pump or minipump, such as an Alzet pump (Durect, Cupertino, Calif.). In one embodiment, a pump and reservoir are implanted in an area distant from the tissue, e.g., in the abdomen, and delivery is effected by a conduit leading from the pump or reservoir to the site of release. Infusion of the dsRNA composition into the brain can be over several hours or for several days, e.g., for 1, 2, 3, 5, or 7 days or more. Devices for delivery to the brain are described, for example, in U.S. Pat. Nos. 6,093,180, and 5,814,014.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the dsRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearoylphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). DsRNAs featured in the invention may be encapsulated within liposomes or may form complexes thereto, in particular to cationic liposomes. Alternatively, dsRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S. T. P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic acid lipid particles

In one embodiment, a GNAQ dsRNA featured in the invention is fully encapsulated in the lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. In some embodiments the lipid to dsRNA ratio can be about 1:1, 2:1, 3:1, 4:1, 5:1, 6:1, 7:1, 8:1, 9:1, 10:1, or 11:1.

The cationic lipid may be, for example, N,N-dioleyl-N,N-dimethylammonium chloride (DODAC), N,N-distearyl-N,N-dimethylammonium bromide (DDAB), N-I-(2,3-dioleoyloxy)propyl)-N,N,N-trimethylammonium chloride (DOTAP), N-I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethyleaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). Other examples of PEG conjugates include PEG-cDMA (N-[(methoxy poly(ethylene glycol)2000)carbamyl]-1,2-dimyristyloxlpropyl-3-amine), mPEG2000-DMG (mPEG-dimyrystylglycerol (with an average molecular weight of 2,000) and PEG-C-DOMG (R-3-[(ω-methoxy-poly(ethylene glycol) 2000)carbamoyl)]-1,2-dimyristyloxlpropyl-3-amine). The conjugated lipid that prevents aggregation of particles may be from 0 mol % to about 20 mol % or about 1.0, 1.1., 1.2, 0.13, 1.4, 1.5, 1.6, 1.7, 1.8, 1.9, or 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S.

provisional patent application No. 61/107,998 filed on Oct. 23, 2008, which is herein incorporated by reference.

For example, the lipid-siRNA particle can include 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

In still another embodiment, the compound 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) can be used to prepare lipid-siRNA particles. For example, the dsRNA can be formulated in a lipid formulation comprising Tech-G1, distearoyl phosphatidylcholine (DSPC), cholesterol and mPEG2000-DMG at a molar ratio of 50:10:38.5:1.5 at a total lipid to siRNA ratio of 7:1 (wt:wt).

LNP01

In one embodiment, the lipidoid ND98.4HCl (MW 1487) (Formula 1), Cholesterol (Sigma-Aldrich), and PEG-Ceramide C16 (Avanti Polar Lipids) can be used to prepare lipid-siRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous siRNA (e.g., in sodium acetate pH 5) such that the final ethanol concentration is about 35-45% and the final sodium acetate concentration is about 100-300 mM. Lipid-siRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula I

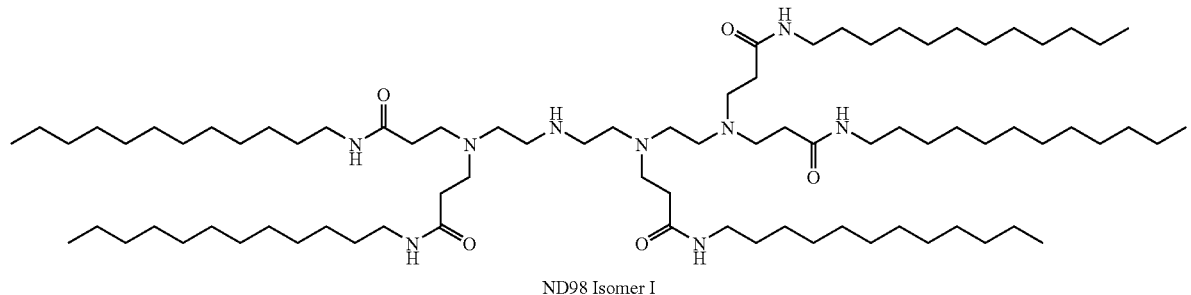

ND98 Isomer I

LNP01 formulations are described, e.g., in International Application Publication No. WO 2008/042973, which is hereby incorporated by reference.

Additional exemplary lipid-siRNA formulations are as follows:

|  | Cationic Lipid | cationic lipid/non-cationic lipid/cholesterol/PEG-lipid conjugate Lipid:siRNA ratio | Process |
| --- | --- | --- | --- |
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |  |
| SNALP-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |  |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 | Extrusion |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 | Extrusion |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 | In-line mixing |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 | In-line mixing |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 | In-line mixing |

| | Cationic Lipid | cationic lipid/non-cationic lipid/cholesterol/PEG-lipid conjugate Lipid:siRNA ratio | Process |
|---|---|---|---|
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 | In-line mixing |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 | In-line mixing |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 | In-line mixing |

LNP09 formulations and XTC comprising formulations are described, e.g., in U.S. Provisional Ser. No. 61/239,686, filed Sep. 3, 2009, which is hereby incorporated by reference.

LNP11 formulations and MC3 comprising formulations are described, e.g., in U.S. Provisional Ser. No. 61/244,834, filed Sep. 22, 2009, which is hereby incorporated by reference.

LNP12 formulations and TechG1 comprising formulations are described, e.g., in U.S. Provisional Ser. No. 61/175,770, filed May 5, 2009, which is hereby incorporated by reference.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total siRNA concentration in the formulation, as well as the entrapped fraction, is estimated using a dye exclusion assay. A sample of the formulated siRNA can be incubated with an RNA-binding dye, such as Ribogreen (Molecular Probes) in the presence or absence of a formulation disrupting surfactant, e.g., 0.5% Triton-X100. The total siRNA in the formulation can be determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Emulsions

The compositions of the present invention may be prepared and formulated as emulsions. Emulsions are typically heterogeneous systems of one liquid dispersed in another in the form of droplets usually exceeding 0.1 μm in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (M0310), hexaglycerol monooleate (PO310), hexaglycerol pentaoleate (PO500), decaglycerol monocaprate (MCA750), decaglycerol monooleate (M0750), decaglycerol sequioleate (S0750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C.sub.1-10 alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines) (Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4' isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

In some embodiments, pharmaceutical compositions featured in the invention include (a) one or more dsRNA compounds and (b) one or more anti-cytokine biologic agents which function by a non-RNAi mechanism. Examples of such biologics include, biologics that target IL1β (e.g., anakinra), IL6 (tocilizumab), or TNF (etanercept, infliximab, adlimumab, or certolizumab).

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dsRNAs featured in the invention can be administered in combination with other known agents effective in treatment of pathological processes mediated by GNAQ expression. In any event, the administering physician can adjust the amount and timing of dsRNA administration on the basis of results observed using standard measures of efficacy known in the art or described herein.

Methods for treating diseases caused by expression of a GNAQ gene

The invention relates in particular to the use of a dsRNA targeting GNAQ and compositions containing at least one such dsRNA for the treatment of a GNAQ-mediated disorder or disease. For example, a dsRNA targeting a GNAQ gene can be useful for the treatment of cancers that have either an activating mutation of GNAQ and/or are the result of overexpression of GNAQ. Tumors to be targeted include uveal melanoma, cutaneous melanoma, Blue nevi, Nevi of Ota, and neuroendocrine tumors (including but not limited to carcinoid tumors, large cell lung cancer, and small cell lung cancer).

A dsRNA targeting a GNAQ gene is also used for treatment of symptoms of disorders, such as uveal melanoma. Symptoms associated include, e.g., melanoma progression, increasing eye pressure, pain in the eye, and impaired peripheral vision.

Owing to the inhibitory effects on GNAQ expression, a composition according to the invention or a pharmaceutical composition prepared therefrom can enhance the quality of life.

The invention further relates to the use of a dsRNA or a pharmaceutical composition thereof, e.g., for treating a GNAQ mediated disorder or disease, in combination with other pharmaceuticals and/or other therapeutic methods, e.g., with known pharmaceuticals and/or known therapeutic methods, such as, for example, those which are currently employed for treating these disorders. In one example, a dsRNA targeting GNAQ can be administered in combination with radiation therapy. In other examples, a dsRNA targeting GNAQ can be administered in combination with a pharmaceutical or therapeutic method for treating a symptom of a GNAQ disease, such as pain medication.

The dsRNA and an additional therapeutic agent can be administered in the same combination, e.g., parenterally, or the additional therapeutic agent can be administered as part of a separate composition or by another method described herein.

The invention features a method of administering a dsRNA targeting GNAQ to a patient having a disease or disorder mediated by GNAQ expression, such as a uveal melanoma. Administration of the dsRNA can stabilize and improve vision, for example, in a patient with uveal melanoma. Patients can be administered a therapeutic amount of dsRNA, such as 0.5 mg/kg, 1.0 mg/kg, 1.5 mg/kg, 2.0 mg/kg, or 2.5 mg/kg dsRNA. The dsRNA can be administered by intravenous infusion over a period of time, such as over a 5 minute, 10 minute, 15 minute, 20 minute, or 25 minute period. The administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the dsRNA can reduce GNAQ levels in the blood or urine of the patient by at least 20%, 25%, 30%, 40%, 50%, 60%, 70%, 80% or 90% or more.

Before administration of a full dose of the dsRNA, patients can be administered a smaller dose, such as a 5% infusion reaction, and monitored for adverse effects, such as an allergic reaction.

Many GNAQ-associated diseases and disorders are hereditary. Therefore, a patient in need of a GNAQ dsRNA can be identified by taking a family history. A healthcare provider, such as a doctor, nurse, or family member, can take a family history before prescribing or administering a GNAQ dsRNA. A DNA test may also be performed on the patient to identify a mutation in the GNAQ gene, before a GNAQ dsRNA is administered to the patient.

Methods for inhibiting expression of a GNAQ gene

In yet another aspect, the invention provides a method for inhibiting the expression of a GNAQ gene in a mammal. The method includes administering a composition featured in the invention to the mammal such that expression of the target GNAQ gene is reduced or silenced.

When the organism to be treated is a mammal such as a human, the composition may be administered by any means known in the art including, but not limited to oral or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the dsRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

Other embodiments are, for example, in the claims.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, Proteins: Structures and Molecular Properties (W.H. Freeman and Company, 1993); A. L. Lehninger, Biochemistry (Worth Publishers, Inc., current addition); Sambrook, et al., Molecular Cloning: A Laboratory Manual (2nd Edition, 1989); Methods In Enzymology (S. Colowick and N. Kaplan eds., Academic Press, Inc.); Remington's Pharmaceutical Sciences, 18th Edition (Easton, Pa.: Mack Publishing Company, 1990); Carey and Sundberg Advanced Organic Chemistry 3rd Ed. (Plenum Press) Vols A and B (1992).

Example 1 dsRNA synthesis

Source of reagents

Where the source of a reagent is not specifically given herein, such reagent may be obtained from any supplier of reagents for molecular biology at a quality/purity standard for application in molecular biology.

Conjugates

For the synthesis of 3'-cholesterol-conjugated siRNAs (herein referred to as -Chol-3'), an appropriately modified solid support is used for RNA synthesis. The modified solid support is prepared as follows:

Diethyl-2-azabutane-1,4-dicarboxylate AA

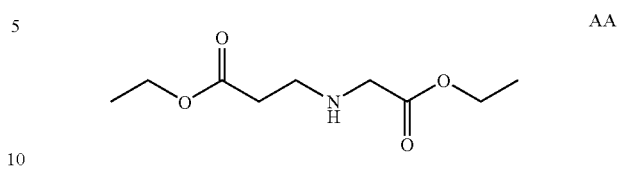

A 4.7 M aqueous solution of sodium hydroxide (50 mL) is added into a stirred, ice-cooled solution of ethyl glycinate hydrochloride (32.19 g, 0.23 mole) in water (50 mL). Then, ethyl acrylate (23.1 g, 0.23 mole) is added and the mixture is stirred at room temperature until completion of the reaction is ascertained by TLC. After 19 h the solution is partitioned with dichloromethane (3×100 mL). The organic layer is dried with anhydrous sodium sulfate, filtered and evaporated. The residue is distilled to afford AA (28.8 g, 61%).

3-{Ethoxycarbonylmethyl-[6-(9H-fluoren-9-yl-methoxycarbonyl-amino)-hexanoyl]-amino}-propionic acid ethyl ester AB

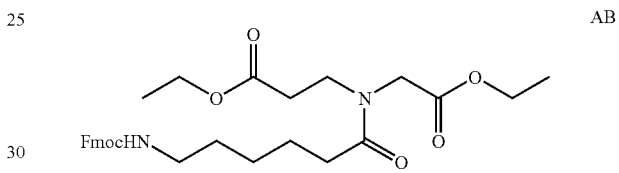

Fmoc-6-amino-hexanoic acid (9.12 g, 25.83 mmol) is dissolved in dichloromethane (50 mL) and cooled with ice. Diisopropylcarbodiimde (3.25 g, 3.99 mL, 25.83 mmol) is added to the solution at 0° C. It is then followed by the addition of Diethyl-azabutane-1,4-dicarboxylate (5 g, 24.6 mmol) and dimethylamino pyridine (0.305 g, 2.5 mmol). The solution is brought to room temperature and stirred further for 6 h. Completion of the reaction is ascertained by TLC. The reaction mixture is concentrated under vacuum and ethyl acetate is added to precipitate diisopropyl urea. The suspension is filtered. The filtrate is washed with 5% aqueous hydrochloric acid, 5% sodium bicarbonate and water. The combined organic layer is dried over sodium sulfate and concentrated to give the crude product which is purified by column chromatography (50% EtOAC/Hexanes) to yield 11.87 g (88%) of AB.

3-[(6-Amino-hexanoyl)-ethoxycarbonylmethyl-amino]-propionic acid ethyl ester AC

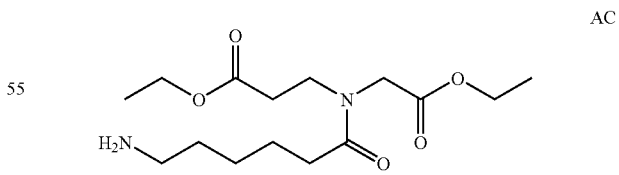

3-{Ethoxycarbonylmethyl-[6-(9H-fluoren-9-ylmethoxycarbonylamino)-hexanoyl]-amino}-propionic acid ethyl ester AB (11.5 g, 21.3 mmol) is dissolved in 20% piperidine in dimethylformamide at 0° C. The solution is continued stirring for 1 h. The reaction mixture is concentrated under vacuum, water is added to the residue, and the product is extracted with ethyl acetate. The crude product is purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic acid ethyl ester AD

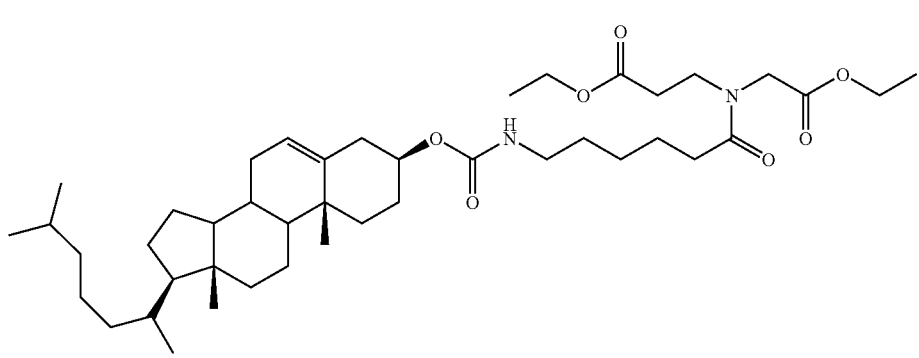

AD

The hydrochloride salt of 3-[(6-Amino-hexanoyl)-ethoxy-carbonylmethyl-amino]-propionic acid ethyl ester AC (4.7 g, 14.8 mmol) is taken up in dichloromethane. The suspension is cooled to 0° C. on ice. To the suspension diisopropylethylamine (3.87 g, 5.2 mL, 30 mmol) is added. To the resulting solution cholesteryl chloroformate (6.675 g, 14.8 mmol) is added. The reaction mixture is stirred overnight. The reaction mixture is diluted with dichloromethane and washed with 10% hydrochloric acid. The product is purified by flash chromatography (10.3 g, 92%).

1-{6-[17-(1,5-Dimethyl-hexyl)-10,13-dimethyl-2,3,4,7,8,9,10,11,12,13,14,15,16,17-tetradecahydro-1H-cyclopenta[a] phenanthren-3-yloxycarbonylamino]-hexanoyl}-4-oxo-pyrrolidine-3-carboxylic acid ethyl ester AE

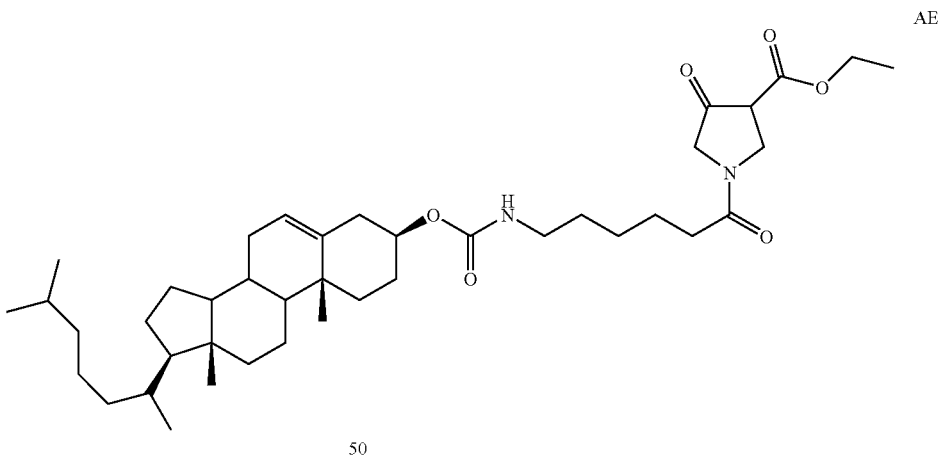

AE

Potassium t-butoxide (1.1 g, 9.8 mmol) is slurried in 30 mL of dry toluene. The mixture is cooled to 0° C. on ice and 5 g (6.6 mmol) of diester AD is added slowly with stirring within 20 mins. The temperature is kept below 5° C. during the addition. The stirring is continued for 30 mins at 0° C. and 1 mL of glacial acetic acid is added, immediately followed by 4 g of $NaH_2PO_4 \cdot H_2O$ in 40 mL of water The resultant mixture is extracted twice with 100 mL of dichloromethane each and the combined organic extracts are washed twice with 10 mL of phosphate buffer each, dried, and evaporated to dryness. The residue is dissolved in 60 mL of toluene, cooled to 0° C. and extracted with three 50 mL portions of cold pH 9.5 carbonate buffer. The aqueous extracts are adjusted to pH 3 with phosphoric acid, and extracted with five 40 mL portions of chloroform which are combined, dried and evaporated to dryness. The residue is purified by column chromatography using 25% ethylacetate/hexane to afford 1.9 g of b-ketoester (39%).

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AF

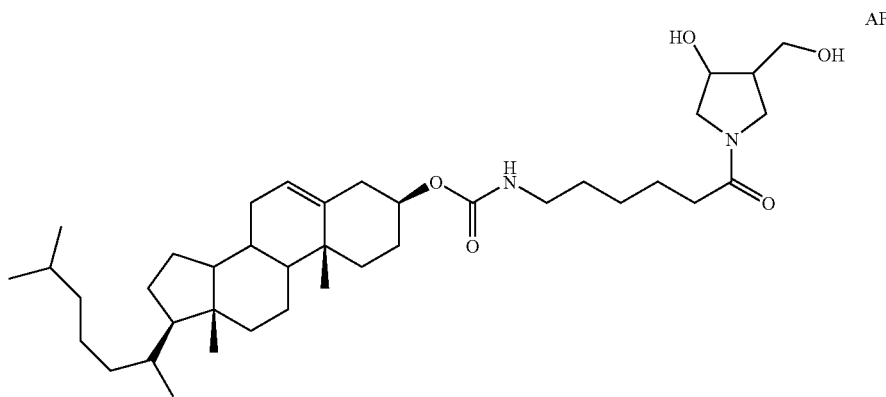

Methanol (2 mL) is added dropwise over a period of 1 h to a refluxing mixture of b-ketoester AE (1.5 g, 2.2 mmol) and sodium borohydride (0.226 g, 6 mmol) in tetrahydrofuran (10 mL). Stirring is continued at reflux temperature for 1 h. After cooling to room temperature, 1 N HCl (12.5 mL) is added, the mixture is extracted with ethylacetate (3×40 mL). The combined ethylacetate layer is dried over anhydrous sodium sulfate and concentrated under vacuum to yield the product which is purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AG Diol AF (1.25 gm 1.994 mmol) is dried by evaporating with pyridine (2×5 mL) in vacuo. Anhydrous pyridine (10 mL) and 4,4'-dimethoxytritylchloride (0.724 g, 2.13 mmol) are added with stirring. The reaction is carried out at room temperature overnight. The reaction is quenched by the addition of methanol. The reaction mixture is concentrated under vacuum and to the residue dichloromethane (50 mL) is added. The organic layer is washed with 1M aqueous sodium bicarbonate. The organic layer is dried over anhydrous sodium sulfate, filtered and concentrated. The residual pyridine is removed by evaporating with toluene. The crude product is purified by column chromatography (2% MeOH/Chloroform, Rf=0.5 in 5% MeOH/CHCl$_3$) (1.75 g, 95%).

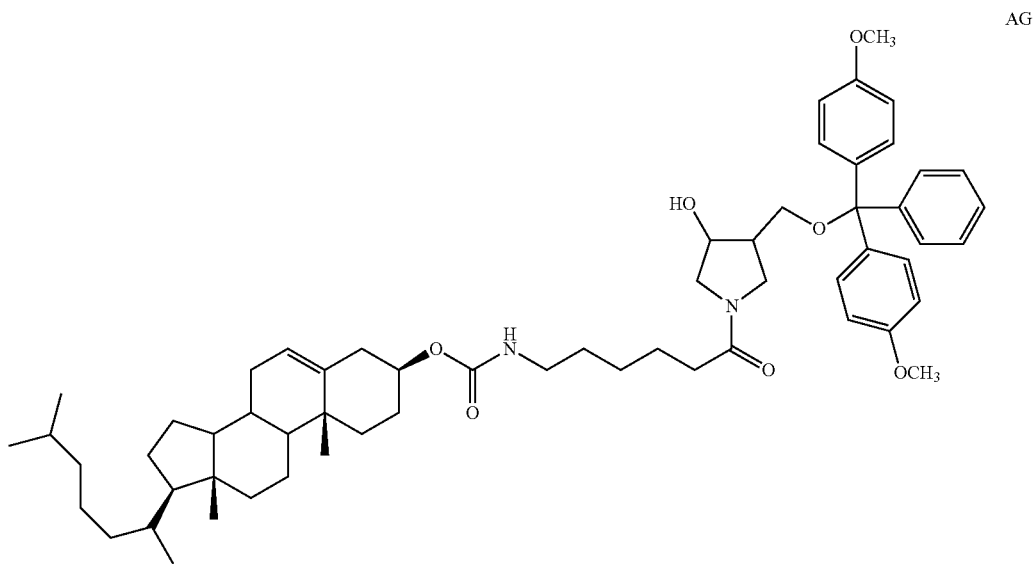

Succinic acid mono-(4-[bis-(4-methoxy-phenyl)-phenyl-methoxymethyl]-1-{6-[17-(1,5-dimethyl-hexyl)-10,13-dimethyl 2,3,4,7,8,9,10,11,12,13,14,15,16,17-tetradecahydro-1H-cyclopenta[a]phenanthren-3-yloxycarbonylamino]-hexanoyl}-pyrrolidin-3-yl) ester AH

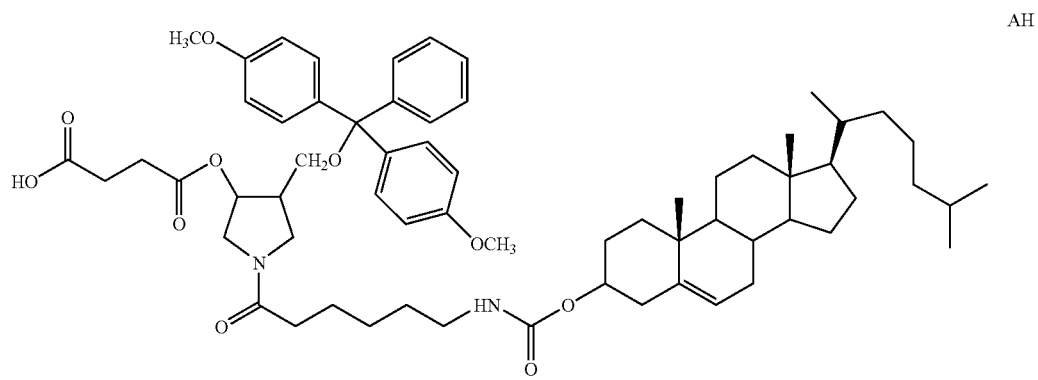

AH

Compound AG (1.0 g, 1.05 mmol) is mixed with succinic anhydride (0.150 g, 1.5 mmol) and DMAP (0.073 g, 0.6 mmol) and dried in a vacuum at 40° C. overnight. The mixture is dissolved in anhydrous dichloroethane (3 mL), triethylamine (0.318 g, 0.440 mL, 3.15 mmol) is added and the solution is stirred at room temperature under argon atmosphere for 16 h. It is then diluted with dichloromethane (40 mL) and washed with ice cold aqueous citric acid (5 wt %, 30 mL) and water (2×20 mL). The organic phase is dried over anhydrous sodium sulfate and concentrated to dryness. The residue is used as such for the next step.

Cholesterol Derivatised CPG AI

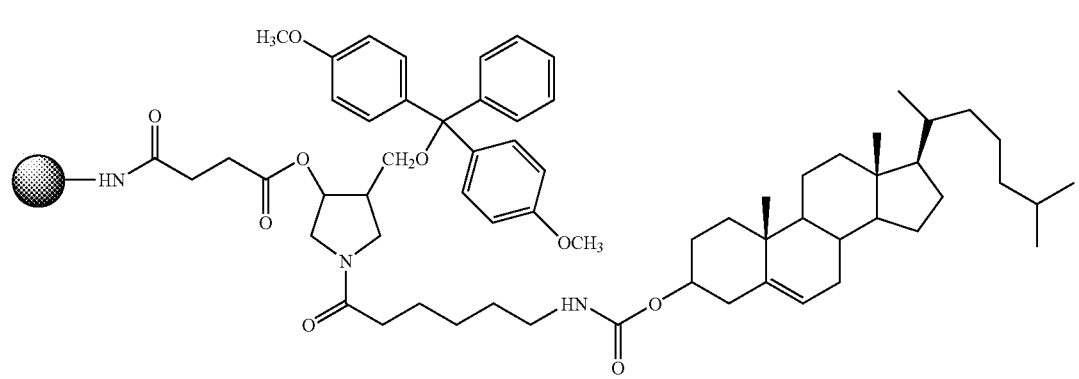

AI

Succinate AH (0.254 g, 0.242 mmol) is dissolved in a mixture of dichloromethane/acetonitrile (3:2, 3 mL). To that solution DMAP (0.0296 g, 0.242 mmol) in acetonitrile (1.25 mL), 2,2'-Dithio-bis(5-nitropyridine) (0.075 g, 0.242 mmol) in acetonitrile/dichloroethane (3:1, 1.25 mL) are added successively. To the resulting solution triphenylphosphine (0.064 g, 0.242 mmol) in acetonitrile (0.6 ml) is added. The reaction mixture turned bright orange in color. The solution is agitated briefly using a wrist-action shaker (5 mins). Long chain alkyl amine-CPG (LCAA-CPG) (1.5 g, 61 mM) is added. The suspension is agitated for 2 h. The CPG is filtered through a sintered funnel and washed with acetonitrile, dichloromethane and ether successively. Unreacted amino groups are masked using acetic anhydride/pyridine. The achieved loading of the CPG is measured by taking UV measurement (37 mM/g).

The synthesis of siRNAs bearing a 5'-12-dodecanoic acid bisdecylamide group (herein referred to as "5'-C32-") or a 5'-cholesteryl derivative group (herein referred to as "5'-Chol-") is performed as described in WO 2004/065601, except that, for the cholesteryl derivative, the oxidation step is performed using the Beaucage reagent in order to introduce a phosphorothioate linkage at the 5'-end of the nucleic acid oligomer.

Nucleic acid sequences are represented herein using standard nomenclature, and specifically the abbreviations of Table 1.

TABLE 1

Abbreviations of nucleoside monomers used in nucleic acid sequence representation. It will be understood that these monomers, when present in an oligonucleotide, are mutually linked by 5'-3'-phosphodiester bonds.

| Abbreviation | Nucleoside(s) |
|---|---|
| A | adenosine |
| C | cytidine |

TABLE 1-continued

Abbreviations of nucleoside monomers used in nucleic acid sequence representation. It will be understood that these monomers, when present in an oligonucleotide, are mutually linked by 5'-3'-phosphodiester bonds.

| Abbreviation | Nucleoside(s) |
|---|---|
| G | guanosine |
| U | uridine |
| N | any nucleotide (G, A, C, U, or dT) |
| a | 2'-O-methyladenosine |
| c | 2'-O-methylcytidine |
| g | 2'-O-methylguanosine |
| u | 2'-O-methyluridine |
| dT | 2'-deoxythymidine |
| s | a phosphorothioate linkage |

Example 2 siRNA Design and Synthesis

Transcripts siRNA design was carried out to identify siRNAs targeting the G-alpha q subunit (GNAQ) of a heterotrimeric G gene. Three sets were designed, each specific for a different set of cross species: 1: human and monkey; 2) human, monkey and mouse; and 3) mouse and rat. GNAQ sequences were obtained from the NCBI Refseq collection on Nov. 24, 2008 as follows:

| Species | GNAQ sequence ref |
|---|---|
| human | NM_002072.2 |
| rat | NM_031036.1 |
| monkey | AB170509.1 |
| mouse | NM_008139.5 | siRNA Design and Specificity Prediction

The predicted specificity of all possible 19mers was determined for each sequence. The GNAQ siRNAs were used in a comprehensive search against the human, cynomolgus monkey, mouse and rat transcriptomes (defined as the set of NM_ and XM_ records within the NCBI Refseq set for human, mouse and rat, and the 'core' sequences from the Unigene clusters for *Macaca fascicularis*) using the FASTA algorithm. The Python script 'offtargetFasta.py' was then used to parse the alignments and generate a score based on the position and number of mismatches between the siRNA and any potential 'off-target' transcript. The off-target score is weighted to emphasize differences in the 'seed' region of siRNAs, in positions 2-9 from the 5' end of the molecule. The off-target score is calculated as follows: mismatches between the oligo and the transcript are given penalties. A mismatch in the seed region in positions 2-9 of the oligo is given a penalty of 2.8; mismatches in the putative cleavage sites 10 and 11 are given a penalty of 1.2, and all other mismatches a penalty of 1. The off-target score for each oligo-transcript pair is then calculated by summing the mismatch penalties. The lowest off-target score from all the oligo-transcript pairs is then determined and used in subsequent sorting of oligos. Both siRNA strands were assigned to a category of specificity according to the calculated scores: a score above 3 qualifies as highly specific, equal to 3 as specific, and between 2.2 and 2.8 as moderately specific. In picking which oligos to synthesize, off-target score of the antisense strand was sorted from high to low.

Synthesis of dsRNA

The sense and antisense strands of the dsRNA duplexes were synthesized on a MerMade 192 synthesizer at 1 µmol scale. For each sense and antisense sequence listed in Tables 2a, 3a, and 4a, sequence were modified as follows and as listed in Tables 2d, 3d, and 4d:

1. In the sense strand, all pyrimidines (U, C) were replaced with corresponding 2'-O-Methyl bases (2' O-Methyl C and 2'-O-Methyl U); in the antisense strand, all pyrimidines (U, C) adjacent to A (UA, CA) were replaced with corresponding 2'-O-Methyl bases (2' O-Methyl C and 2'-O-Methyl U); a 2 base dTdT extension at the 3' end of both strands was introduced.
2. In the sense strand, all pyrimidines (U, C) are replaced with corresponding 2'-O-Methyl bases (2' O-Methyl C and 2'-O-Methyl U); in the antisense strand, all pyrimidines (U, C) adjacent to A (UA, CA) are replaced with corresponding 2'-O-Methyl bases (2' O-Methyl C and 2'-O-Methyl U); a 2 base dTsdT (including a phosphorothioate) extension at the 3' end of both strands was introduced.
3. In the sense strand, all pyrimidines (U, C) are replaced with corresponding 2'-O-Methyl bases (2' O-Methyl C and 2'-O-Methyl U); in the antisense strand, all pyrimidines (U, C) adjacent to A (UA, CA) and all U adjacent to another U (UU) or G (UG) were replaced with corresponding 2'-O-Methyl bases (2' O-Methyl C and 2'-O-Methyl U); a 2 base dTsdT (including a phosphorothioate) extension at the 3' end of both strands was introduced.

The synthesis of each strand of the dsRNA used solid supported oligonucleotide synthesis using phosphoramidite chemistry.

Synthesis was performed at 1 umole scale in 96 well plates. The amidite solutions were prepared at 0.1M concentration and ethyl thio tetrazole (0.6M in Acetonitrile) was used as an activator. The synthesized sequences were cleaved and deprotected in 96 well plates, using methylamine in the first step and triethylamine.3HF in the second step. The crude sequences thus obtained were precipitated using acetone: ethanol mix and the pellet were re-suspended in 0.5M sodium acetate buffer. Samples from each sequence were analyzed by LC-MS and the resulting mass data confirmed the identity of the sequences. A selected set of samples were also analyzed by IEX chromatography.

All sequences were purified on AKTA explorer purification system using Source 15Q column. A single peak corresponding to the full length sequence was collected in the eluent and was subsequently analyzed for purity by ion exchange chromatography.

The purified sequences were desalted on a Sephadex G25 column using AKTA purifier. The desalted sequences were analyzed for concentration and purity. For the preparation of duplexes, equimolar amounts of sense and antisense strand were heated in the required buffer (e.g. 1×PBS) at 95° C. for 2-5 minutes and slowly cooled to room temperature. Integrity of the duplex was confirmed by HPLC analysis.

Synthesis and Duplex Annealing for in vivo Studies

Step 1. Oligonucleotide Synthesis

Oligonucleotides for in vivo studies were synthesized on an AKTA oligopilot synthesizer or on an ABI 394 DNA/RNA synthesizer. Commercially available controlled pore glass solid support (dT-CPG, 500 Å, Prime Synthesis) or the in-house synthesized solid support cholesterol-CPG, AI were used for the synthesis. Other ligand conjugated solid supports amenable to the invention are described in U.S. patent application Ser. No. 10/946,873 filed Sep. 21, 2004, which is hereby incorporated by reference for all purposes. RNA phosphoramidites and 2'-β-methyl modified RNA phosphoramidites with standard protecting groups (5'-O-dimethoxytrityl-N6-benzoyl-2'-t-butyldimethylsilyl-adenosine-3'-O-N,N'-diisopropyl-2-cyanoethylphosphoramidite, 5'-O-dimethoxytrityl-N4-acetyl-2'-t-butyldimethylsilyl-cytidine-3'-O-N,N'-diisopropyl-2-cyanoethylphosphoramidite, 5'-O-dimethoxytrityl-N2-isobutryl-2'-t-butyldimethylsilyl-guanosine-3'-O-N,N'-diisopropyl-2-cyanoethylphosphoramidite, 5'-O-dimethoxytrityl-2'-t-butyldimethylsilyl-uridine-3'-O-N,N'-diisopropyl-2-cyanoethylphosphoramidite, 5'-O-dimethoxytrityl-N6-benzoyl-2'-O-methyl-adenosine-3'-O—N,N'-diisopropyl-2-cyanoethylphosphoramidite, 5'-O-dimethoxytrityl-N4-acetyl-2'-O-methyl-cytidine-3'-O-N,N'-diisopropyl-2-cyanoethylphosphoramidite, 5'-O-dimethoxytrityl-N2-isobutryl-2'-O-methyl-guanosine-3'-O-N,N'-diisopropyl-2-cyanoethylphosphoramidite, 5'-O-dimethoxytrityl-2'-O-methyl-uridine-3'-O-N,N'-diisopropyl-2-cyanoethylphosphoramidite and 5'-O-dimethoxytrityl-2'-deoxy-thymidine-3'-O-N,N'-diisopropyl-2-cyanoethylphosphoramidite) were obtained commercially (e.g. from Pierce Nucleic Acids Technologies and Chem-Genes Research).

For the syntheses on AKTAoligopilot synthesizer, all phosphoramidites were used at a concentration of 0.2 M in $CH_3CN$ except for guanosine and 2'-O-methyl-uridine, which were used at 0.2 M concentration in 10% $THF/CH_3CN$ (v/v). Coupling/recycling time of 16 minutes was used for all phosphoramidite couplings. The activator was 5-ethyl-thio-tetrazole (0.75 M, American International Chemicals). For the PO-oxidation, 50 mM iodine in water/pyridine (10:90 v/v) was used and for the PS-oxidation 2% PADS (GL Synthesis) in 2,6-lutidine/$CH_3CN$ (1:1 v/v) was used. For the syntheses on ABI 394 DNA/RNA synthesizer, all phosphoramidites were used at a concentration of 0.15 M in $CH_3CN$ except for 2'-O-methyl-uridine, which was used at 0.15 M concentration in 10% $THF/CH_3CN$ (v/v). Coupling time of 10 minutes was used for all phosphoramidite couplings. The activator was 5-ethyl-thio-tetrazole (0.25 M, Glen Research). For the PO-oxidation, 20 mM iodine in water/pyridine (Glen Research) was used and for the PS-oxidation 0.1M DDTT (AM Chemicals) in pyridine was used.

Step 2. Deprotection of oligonucleotides

After completion of synthesis, the support was transferred to a 100 mL glass bottle (VWR). The oligonucleotide was cleaved from the support with simultaneous deprotection of base and phosphate groups with 40 mL of a 40% aq. methyl amine (Aldrich) 90 mins at 45° C. The bottle was cooled briefly on ice and then the methylamine was filtered into a new 500 mL bottle. The CPG was washed three times with 40 mL portions of DMSO. The mixture was then cooled on dry ice.

In order to remove the tert-butyldimethylsilyl (TBDMS) groups at the 2' position, 60 mL triethylamine trihydrofluoride (Et3N—HF) was added to the above mixture. The mixture was heated at 40° C. for 60 minutes. The reaction was then quenched with 220 mL of 50 mM sodium acetate (pH 5.5) and stored in the freezer until purification.

Sequences synthesized on the ABI DNA/RNA synthesizer

After completion of synthesis, the support was transferred to a 15 mL tube (VWR). The oligonucleotide was cleaved from the support with simultaneous deprotection of base and phosphate groups with 7 mL of a 40% aq. methyl amine (Aldrich) 15 mins at 65° C. The bottle was cooled briefly on ice and then the methylamine solution was filtered into a 100 mL bottle (VWR). The CPG was washed three times with 7 mL portions of DMSO. The mixture was then cooled on dry ice.

In order to remove the tert-butyldimethylsilyl (TBDMS) groups at the 2' position, 10.5 mL triethylamine trihydrofluoride (Et3N-HF) was added to the above mixture. The mixture was heated at 60° C. for 15 minutes. The reaction was then quenched with 38.5 mL of 50 mM sodium acetate (pH 5.5) and stored in the freezer until purification.

Step 3. Quantitation of Crude Oligonucleotides

For all samples, a 10 μL aliquot was diluted with 990 μL of deionised nuclease free water (1.0 mL) and the absorbance reading at 260 nm obtained.

Step 4. Purification of oligonucleotides

Unconjugated oligonucleotides

The unconjugated samples were purified by HPLC on a TSK-Gel SuperQ-5PW (20) column packed in house (17.3×5 cm) or on a commercially available TSK-Gel SuperQ-5PW column (15×0.215 cm) available from TOSOH Bioscience. The buffers were 20 mM phosphate in 10% $CH_3CN$, pH 8.5 (buffer A) and 20 mM phosphate, 1.0 M NaBr in 10% $CH_3CN$, pH 8.5 (buffer B). The flow rate was 50.0 mL/min for the in house packed column and 10.0 ml/min for the commercially obtained column. Wavelengths of 260 and 294 nm were monitored. The fractions containing the full-length oligonucleotides were pooled together, evaporated, and reconstituted to ~100 mL with deionised water.

Cholesterol-conjugated oligonucleotides

The cholesterol conjugated sequences were HPLC purified on RPC-Source15 reverse-phase columns packed in house (17.3×5 cm or 15×2 cm). The buffers were 20 mM NaOAc in 10% $CH_3CN$ (buffer A) and 20 mM NaOAc in 70% $CH_3CN$ (buffer B). The flow rate was 50.0 mL/min for the 17.3×5 cm column and 12.0 ml/min for the 15×2 cm column. Wavelengths of 260 and 284 nm were monitored. The fractions containing the full-length oligonucleotides were pooled, evaporated, and reconstituted to 100 mL with deionised water.

Step 5. Desalting of Purified Oligonucleotides

The purified oligonucleotides were desalted on either an AKTA Explorer or an AKTA Prime system (Amersham Biosciences) using a Sephadex G-25 column packed in house. First, the column was washed with water at a flow rate of 40 mL/min for 20-30 min. The sample was then applied in 40-60 mL fractions. The eluted salt-free fractions were combined, dried, and reconstituted in ~50 mL of RNase free water.

Step 6. Purity Analysis

Approximately 0.3 OD of each of the desalted oligonucleotides was diluted in water to 300 μL and were analyzed by CGE, ion exchange HPLC, and LC/MS.

Step 7. Duplex Formation

For the preparation of duplexes, equimolar amounts of sense and antisense strand were heated in the required buffer (e.g. 1×PBS) at 95° C. for 5 min and slowly cooled to room temperature. Integrity of the duplex was confirmed by HPLC analysis.

Tables of dsRNA sequences

Table 2 provides sequences used for design of dsRNA targeting human GNAQ that will cross react with monkey GNAQ. Table 3 provides sequences used for design of dsRNA targeting human GNAQ that will cross react with both monkey and rat GNAQ. Table 4 provides sequences used for design of dsRNA targeting rat GNAQ that will cross react with mouse GNAQ.

Tables 2a, 3a, and 4a following tables provide the sense and antisense strand of GNAQ target sequences. Tables 2b, 3b, and 4b provide exemplary sense and antisense dsRNA strands with a NN 2 base overhang. Tables 2c, 3c, and 4c provide exemplary sense and antisense dsRNA strands with dTdT 2 base overhang. Tables 2d, 3d, and 4d provide sequences of dsRNA that were synthesized, including the dTdT 2 base overhang and modified nucleotides.

TABLE 2a

GNAQ (human X monkey): target sequences
Numbering for target sequences is based on Human GNAQ NM_002072.

| Start of target sequence | SEQ ID NO. | Target sequence, sense strand (5'-3') | SEQ ID NO. | Target sequence, antisense strand (5'-3') |
|---|---|---|---|---|
| 1217 | 1 | CUAAUUUAUUGCCGUCCUG | 74 | CAGGACGGCAAUAAAUUAG |
| 1213 | 2 | AAUACUAAUUUAUUGCCGU | 75 | ACGGCAAUAAAUUAGUAUU |
| 1810 | 3 | CAGCCAUAGCUUGAUUGCU | 76 | AGCAAUCAAGCUAUGGCUG |
| 1590 | 4 | GUCAGGACACAUCGUUCGA | 77 | UCGAACGAUGUGUCCUGAC |
| 1149 | 5 | CUUCCCUGGUGGGCUAUUG | 78 | CAAUAGCCCACCAGGGAAG |
| 1971 | 6 | GACACUACAUUACCCUAAU | 79 | AUUAGGGUAAUGUAGUGUC |
| 1237 | 7 | ACUCUGUGUGAGCGUGUCC | 80 | GGACACGCUCACACAGAGU |
| 1152 | 8 | CCCUGGUGGGCUAUUGAAG | 81 | CUUCAAUAGCCCACCAGGG |
| 1216 | 9 | ACUAAUUUAUUGCCGUCCU | 82 | AGGACGGCAAUAAAUUAGU |
| 1575 | 10 | CUCUCAAAUGAUACAGUCA | 83 | UGACUGUAUCAUUUGAGAG |
| 1105 | 11 | AGUACAAUCUGGUCUAAUU | 84 | AAUUAGACCAGAUUGUACU |
| 1407 | 12 | CACAAAGAUAAGACUUGUU | 85 | AACAAGUCUUAUCUUUGUG |
| 1108 | 13 | ACAAUCUGGUCUAAUUGUG | 86 | CACAAUUAGACCAGAUUGU |
| 1395 | 14 | CAGUCAUGCACUCACAAAG | 87 | CUUUGUGAGUGCAUGACUG |
| 1595 | 15 | GACACAUCGUUCGAUUUAA | 88 | UUAAAUCGAACGAUGUGUC |
| 1992 | 16 | CUGCUACCCAGAACCUUUU | 89 | AAAAGGUUCUGGGUAGCAG |
| 1809 | 17 | UCAGCCAUAGCUUGAUUGC | 90 | GCAAUCAAGCUAUGGCUGA |
| 1220 | 18 | AUUUAUUGCCGUCCUGGAC | 91 | GUCCAGGACGGCAAUAAAU |
| 1203 | 19 | CAAUUUGCAUAAUACUAAU | 92 | AUUAGUAUUAUGCAAAUUG |
| 1322 | 20 | GUACAGUCCCAGCACAUUU | 93 | AAAUGUGCUGGGACUGUAC |
| 1804 | 21 | UACCUUCAGCCAUAGCUUG | 94 | CAAGCUAUGGCUGAAGGUA |
| 1968 | 22 | ACAGACACUACAUUACCCU | 95 | AGGGUAAUGUAGUGUCUGU |
| 1214 | 23 | AUACUAAUUUAUUGCCGUC | 96 | GACGGCAAUAAAUUAGUAU |
| 1159 | 24 | GGGCUAUUGAAGAUACACA | 97 | UGUGUAUCUUCAAUAGCCC |
| 1603 | 25 | GUUCGAUUUAAGCCAUCAU | 98 | AUGAUGGCUUAAAUCGAAC |
| 1123 | 26 | UGUGCCUCCUAGACACCCG | 99 | CGGGUGUCUAGGAGGCACA |
| 1233 | 27 | CUGGACUCUGUGUGAGCGU | 100 | ACGCUCACACAGAGUCCAG |
| 1930 | 28 | ACCCUCUCUUUCAAUUGCA | 101 | UGCAAUUGAAAGAGAGGGU |
| 1969 | 29 | CAGACACUACAUUACCCUA | 102 | UAGGGUAAUGUAGUGUCUG |
| 1219 | 30 | AAUUUAUUGCCGUCCUGGA | 103 | UCCAGGACGGCAAUAAAUU |
| 1241 | 31 | UGUGUGAGCGUGUCCACAG | 104 | CUGUGGACACGCUCACACA |
| 1153 | 32 | CCUGGUGGGCUAUUGAAGA | 105 | UCUUCAAUAGCCCACCAGG |
| 1805 | 33 | ACCUUCAGCCAUAGCUUGA | 106 | UCAAGCUAUGGCUGAAGGU |
| 1312 | 34 | GGAUGCUGAAGUACAGUCC | 107 | GGACUGUACUUCAGCAUCC |
| 1546 | 35 | AUCCUAGUUCCAUUCUUGG | 108 | CCAAGAAUGGAACUAGGAU |
| 1547 | 36 | UCCUAGUUCCAUUCUUGGU | 109 | ACCAAGAAUGGAACUAGGA |

TABLE 2a-continued

GNAQ (human X monkey): target sequences
Numbering for target sequences is based on Human
GNAQ NM_002072.

| Start of target sequence | SEQ ID NO. | Target sequence, sense strand (5'-3') | SEQ ID NO. | Target sequence, antisense strand (5'-3') |
|---|---|---|---|---|
| 1103 | 37 | GGAGUACAAUCUGGUCUAA | 110 | UUAGACCAGAUUGUACUCC |
| 1334 | 38 | CACAUUCCUCUCUAUCUU | 111 | AAGAUAGAGAGGAAAUGUG |
| 1255 | 39 | CACAGAGUUUGUAGUAAAU | 112 | AUUUACUACAAACUCUGUG |
| 1967 | 40 | AACAGACACUACAUUACCC | 113 | GGGUAAUGUAGUGUCUGUU |
| 1391 | 41 | UUCUCAGUCAUGCACUCAC | 114 | GUGAGUGCAUGACUGAGAA |
| 1124 | 42 | GUGCCUCCUAGACACCCGC | 115 | GCGGGUGUCUAGGAGGCAC |
| 1612 | 43 | AAGCCAUCAUCAGCUUAAU | 116 | AUUAAGCUGAUGAUGGCUU |
| 1933 | 44 | CUCUCUUUCAAUUGCAGAU | 117 | AUCUGCAAUUGAAAGAGAG |
| 1078 | 45 | ACACCAUCCUCCAGUUGAA | 118 | UUCAACUGGAGGAUGGUGU |
| 1545 | 46 | UAUCCUAGUUCCAUUCUUG | 119 | CAAGAAUGGAACUAGGAUA |
| 1109 | 47 | CAAUCUGGUCUAAUUGUGC | 120 | GCACAAUUAGACCAGAUUG |
| 1398 | 48 | UCAUGCACUCACAAAGAUA | 121 | UAUCUUUGUGAGUGCAUGA |
| 1970 | 49 | AGACACUACAUUACCCUAA | 122 | UUAGGGUAAUGUAGUGUCU |
| 1173 | 50 | ACACAAGAGGGACUGUAUU | 123 | AAUACAGUCCCUCUUGUGU |
| 1313 | 51 | GAUGCUGAAGUACAGUCCC | 124 | GGGACUGUACUUCAGCAUC |
| 1811 | 52 | AGCCAUAGCUUGAUUGCUC | 125 | GAGCAAUCAAGCUAUGGCU |
| 1862 | 53 | CACAGGAGUCCUUUCUUUU | 126 | AAAAGAAAGGACUCCUGUG |
| 1600 | 54 | AUCGUUCGAUUUAAGCCAU | 127 | AUGGCUUAAAUCGAACGAU |
| 1618 | 55 | UCAUCAGCUUAAUUUAAGU | 128 | ACUUAAAUUAAGCUGAUGA |
| 1332 | 56 | AGCACAUUUCCUCUCUAUC | 129 | GAUAGAGAGGAAAUGUGCU |
| 1157 | 57 | GUGGGCUAUUGAAGAUACA | 130 | UGUAUCUUCAAUAGCCCAC |
| 888 | 58 | AUCAUGUAUUCCCAUCUAG | 131 | CUAGAUGGGAAUACAUGAU |
| 1855 | 59 | AAAGACACACAGGAGUCCU | 132 | AGGACUCCUGUGUGUCUUU |
| 1579 | 60 | CAAAUGAUACAGUCAGGAC | 133 | GUCCUGACUGUAUCAUUUG |
| 805 | 61 | UUAGAACAAUUAUCACAUA | 134 | UAUGUGAUAAUUGUUCUAA |
| 1554 | 62 | UCCAUUCUUGGUCAAGUUU | 135 | AAACUUGACCAAGAAUGGA |
| 1113 | 63 | CUGGUCUAAUUGUGCCUCC | 136 | GGAGGCACAAUUAGACCAG |
| 1174 | 64 | CACAAGAGGGACUGUAUUU | 137 | AAAUACAGUCCCUCUUGUG |
| 1735 | 65 | UCUUGUCUCACUUUGGACU | 138 | AGUCCAAAGUGAGACAAGA |
| 1450 | 66 | UUUUCUAUGGAGCAAAACA | 139 | UGUUUUGCUCCAUAGAAAA |
| 1285 | 67 | AUUUAAACUAUUCAGAGGA | 140 | UCCUCUGAAUAGUUUAAAU |
| 804 | 68 | UUUAGAACAAUUAUCACAU | 141 | AUGUGAUAAUUGUUCUAAA |
| 1866 | 69 | GGAGUCCUUUCUUUUGAAA | 142 | UUUCAAAAGAAAGGACUCC |
| 1610 | 70 | UUAAGCCAUCAUCAGCUUA | 143 | UAAGCUGAUGAUGGCUUAA |

TABLE 2a-continued

GNAQ (human X monkey): target sequences
Numbering for target sequences is based on Human GNAQ NM_002072.

| Start of target sequence | SEQ ID NO. | Target sequence, sense strand (5'-3') | SEQ ID NO. | Target sequence, antisense strand (5'-3') |
|---|---|---|---|---|
| 1117 | 71 | UCUAAUUGUGCCUCCUAGA | 144 | UCUAGGAGGCACAAUUAGA |
| 1320 | 72 | AAGUACAGUCCCAGCACAU | 145 | AUGUGCUGGGACUGUACUU |
| 1317 | 73 | CUGAAGUACAGUCCCAGCA | 146 | UGCUGGGACUGUACUUCAG |

TABLE 2b

GNAQ (human and monkey): sense and antisense sequences with 2 base overhangs; Numbering for target sequences is based on Human GNAQ NM_002072.

| SEQ ID NO | SEQUENCE (5'-3') | Strand | Start of target sequence |
|---|---|---|---|
| 147 | CUAAUUUAUUGCCGUCCUGNN | sense | 1217 |
| 148 | CAGGACGGCAAUAAAUUAGNN | antis | 1217 |
| 149 | AAUACUAAUUUAUUGCCGUNN | sense | 1213 |
| 150 | ACGGCAAUAAAUUAGUAUUNN | antis | 1213 |
| 151 | CAGCCAUAGCUUGAUUGCUNN | sense | 1810 |
| 152 | AGCAAUCAAGCUAUGGCUGNN | antis | 1810 |
| 153 | GUCAGGACACAUCGUUCGANN | sense | 1590 |
| 154 | UCGAACGAUGUGUCCUGACNN | antis | 1590 |
| 155 | CUUCCCUGGUGGGCUAUUGNN | sense | 1149 |
| 156 | CAAUAGCCCACCAGGGAAGNN | antis | 1149 |
| 157 | GACACUACAUUACCCUAAUNN | sense | 1971 |
| 158 | AUUAGGGUAAUGUAGUGUCNN | antis | 1971 |
| 159 | ACUCUGUGUGAGCGUGUCCNN | sense | 1237 |
| 160 | GGACACGCUCACACAGAGUNN | antis | 1237 |
| 161 | CCCUGGUGGGCUAUUGAAGNN | sense | 1152 |
| 162 | CUUCAAUAGCCCACCAGGGNN | antis | 1152 |
| 163 | ACUAAUUUAUUGCCGUCCUNN | sense | 1216 |
| 164 | AGGACGGCAAUAAAUUAGUNN | antis | 1216 |
| 165 | CUCUCAAAUGAUACAGUCANN | sense | 1575 |
| 166 | UGACUGUAUCAUUUGAGAGNN | antis | 1575 |
| 167 | AGUACAAUCGGUCUAAUUNN | sense | 1105 |
| 168 | AAUUAGACCAGAUUGUACUNN | antis | 1105 |
| 169 | CACAAAGAUAAGACUUGUUNN | sense | 1407 |
| 170 | AACAAGUCUUAUCUUUGUGNN | antis | 1407 |
| 171 | ACAAUCGGUCUAAUUGUGNN | sense | 1108 |
| 172 | CACAAUUAGACCAGAUUGUNN | antis | 1108 |
| 173 | CAGUCAUGCACUCACAAAGNN | sense | 1395 |
| 174 | CUUUGUGAGUGCAUGACUGNN | antis | 1395 |
| 175 | GACACAUCGUUCGAUUUAANN | sense | 1595 |
| 176 | UUAAAUCGAACGAUGUGUCNN | antis | 1595 |
| 177 | CUGCUACCCAGAACCUUUUNN | sense | 1992 |
| 178 | AAAAGGUUCUGGGUAGCAGNN | antis | 1992 |
| 179 | UCAGCCAUAGCUUGAUUGCNN | sense | 1809 |
| 180 | GCAAUCAAGCUAUGGCUGANN | antis | 1809 |
| 181 | AUUUAUUGCCGUCCUGGACNN | sense | 1220 |
| 182 | GUCCAGGACGGCAAUAAAUNN | antis | 1220 |
| 183 | CAAUUUGCAUAAUACUAAUNN | sense | 1203 |
| 184 | AUUAGUAUUAUGCAAAUUGNN | antis | 1203 |
| 185 | GUACAGUCCCAGCACAUUUNN | sense | 1322 |
| 186 | AAAUGUGCUGGGACUGUACNN | antis | 1322 |
| 187 | UACCUUCAGCCAUAGCUUGNN | sense | 1804 |
| 188 | CAAGCUAUGGCUGAAGGUANN | antis | 1804 |
| 189 | ACAGACACUACAUUACCCUNN | sense | 1968 |
| 190 | AGGGUAAUGUAGUGUCUGUNN | antis | 1968 |
| 191 | AUACUAAUUUAUUGCCGUCNN | sense | 1214 |
| 192 | GACGGCAAUAAAUUAGUAUNN | antis | 1214 |
| 193 | GGGCUAUUGAAGAUACACANN | sense | 1159 |
| 194 | UGUGUAUCUUCAAUAGCCCNN | antis | 1159 |
| 195 | GUUCGAUUUAAGCCAUCAUNN | sense | 1603 |
| 196 | AUGAUGGCUUAAAUCGAACNN | antis | 1603 |
| 197 | UGUGCCUCCUAGACACCCGNN | sense | 1123 |
| 198 | CGGGUGUCUAGGAGGCACANN | antis | 1123 |

TABLE 2b-continued

GNAQ (human and monkey): sense and antisense sequences with 2 base overhangs; Numbering for target sequences is based on Human GNAQ NM_002072.

| SEQ ID NO | SEQUENCE (5'-3') | Strand | Start of target sequence |
|---|---|---|---|
| 199 | CUGGACUCUGUGUGAGCGUNN | sense | 1233 |
| 200 | ACGCUCACACAGAGUCCAGNN | antis | 1233 |
| 201 | ACCCUCUCUUUCAAUUGCANN | sense | 1930 |
| 202 | UGCAAUUGAAAGAGAGGGUNN | antis | 1930 |
| 203 | CAGACACUACAUUACCCUANN | sense | 1969 |
| 204 | UAGGGUAAUGUAGUGUCUGNN | antis | 1969 |
| 205 | AAUUUAUUGCCGUCCUGGNN | sense | 1219 |
| 206 | UCCAGGACGGCAAUAAAUUNN | antis | 1219 |
| 207 | UGUGUGAGCGUGUCCACAGNN | sense | 1241 |
| 208 | CUGUGGACACGCUCACACANN | antis | 1241 |
| 209 | CCUGGUGGGCUAUUGAAGANN | sense | 1153 |
| 210 | UCUUCAAUAGCCCACCAGGNN | antis | 1153 |
| 211 | ACCUUCAGCCAUAGCUUGANN | sense | 1805 |
| 212 | UCAAGCUAUGGCUGAAGGUNN | antis | 1805 |
| 213 | GGAUGCUGAAGUACAGUCCNN | sense | 1312 |
| 214 | GGACUGUACUUCAGCAUCCNN | antis | 1312 |
| 215 | AUCCUAGUUCCAUUCUUGGNN | sense | 1546 |
| 216 | CCAAGAAUGGAACUAGGAUNN | antis | 1546 |
| 217 | UCCUAGUUCCAUUCUUGGUNN | sense | 1547 |
| 218 | ACCAAGAAUGGAACUAGGANN | antis | 1547 |
| 219 | GGAGUACAAUCUGGUCUAANN | sense | 1103 |
| 220 | UUAGACCAGAUUGUACUCCNN | antis | 1103 |
| 221 | CACAUUUCCUCUCUAUCUUNN | sense | 1334 |
| 222 | AAGAUAGAGAGGAAAUGUGNN | antis | 1334 |
| 223 | CACAGAGUUUGUAGUAAAUNN | sense | 1255 |
| 224 | AUUUACUACAAACUCUGUGNN | antis | 1255 |
| 225 | AACAGACACUACAUUACCCNN | sense | 1967 |
| 226 | GGGUAAUGUAGUGUCUGUUNN | antis | 1967 |
| 227 | UUCUCAGUCAUGCACUCACNN | sense | 1391 |
| 228 | GUGAGUGCAUGACUGAGAANN | antis | 1391 |
| 229 | GUGCCUCCUAGACACCCGCNN | sense | 1124 |
| 230 | GCGGGUGUCUAGGAGGCACNN | antis | 1124 |
| 231 | AAGCCAUCAUCAGCUUAAUNN | sense | 1612 |
| 232 | AUUAAGCUGAUGAUGGCUUNN | antis | 1612 |
| 233 | CUCUCUUUCAAUUGCAGAUNN | sense | 1933 |
| 234 | AUCUGCAAUUGAAAGAGAGNN | antis | 1933 |
| 235 | ACACCAUCCUCCAGUUGAANN | sense | 1078 |
| 236 | UUCAACUGGAGGAUGGUGUNN | antis | 1078 |
| 237 | UAUCCUAGUUCCAUUCUUGNN | sense | 1545 |
| 238 | CAAGAAUGGAACUAGGAUANN | antis | 1545 |
| 239 | CAAUCGGUCUAAUUGUGCNN | sense | 1109 |
| 240 | GCACAAUUAGACCAGAUUGNN | antis | 1109 |
| 241 | UCAUGCACUCACAAAGAUANN | sense | 1398 |
| 242 | UAUCUUUGUGAGUGCAUGANN | antis | 1398 |
| 243 | AGACACUACAUUACCCUAANN | sense | 1970 |
| 244 | UUAGGGUAAUGUAGUGUCUNN | antis | 1970 |
| 245 | ACACAAGAGGGACUGUAUUNN | sense | 1173 |
| 246 | AAUACAGUCCCUCUUGUGUNN | antis | 1173 |
| 247 | GAUGCUGAAGUACAGUCCCNN | sense | 1313 |
| 248 | GGGACUGUACUUCAGCAUCNN | antis | 1313 |
| 249 | AGCCAUAGCUUGAUUGCUCNN | sense | 1811 |
| 250 | GAGCAAUCAAGCUAUGGCUNN | antis | 1811 |
| 251 | CACAGGAGUCCUUUCUUUUNN | sense | 1862 |
| 252 | AAAAGAAAGGACUCCUGUGNN | antis | 1862 |
| 253 | AUCGUUCGAUUUAAGCCAUNN | sense | 1600 |
| 254 | AUGGCUUAAAUCGAACGAUNN | antis | 1600 |
| 255 | UCAUCAGCUUAAUUUAAGUNN | sense | 1618 |
| 256 | ACUUAAAUUAAGCUGAUGANN | antis | 1618 |
| 257 | AGCACAUUUCCUCUCUAUCNN | sense | 1332 |
| 258 | GAUAGAGAGGAAAUGUGCUNN | antis | 1332 |
| 259 | GUGGGCUAUUGAAGAUACANN | sense | 1157 |
| 260 | UGUAUCUUCAAUAGCCCACNN | antis | 1157 |
| 261 | AUCAUGUAUUCCCAUCUAGNN | sense | 888 |
| 262 | CUAGAUGGGAAUACAUGAUNN | antis | 888 |
| 263 | AAAGACACACAGGAGUCCUNN | sense | 1855 |
| 264 | AGGACUCCUGUGUGUCUUUNN | antis | 1855 |
| 265 | CAAAUGAUACAGUCAGGACNN | sense | 1579 |
| 266 | GUCCUGACUGUAUCAUUUGNN | antis | 1579 |
| 267 | UUAGAACAAUUAUCACAUANN | sense | 805 |
| 268 | UAUGUGAUAAUUGUUCUAANN | antis | 805 |
| 269 | UCCAUUCUUGGUCAAGUUUNN | sense | 1554 |

TABLE 2b-continued

GNAQ (human and monkey): sense and antisense sequences with 2 base overhangs; Numbering for target sequences is based on Human GNAQ NM_002072.

| SEQ ID NO | SEQUENCE (5'-3') | Strand | Start of target sequence |
|---|---|---|---|
| 270 | AAACUUGACCAAGAAUGGANN | antis | 1554 |
| 271 | CUGGUCUAAUUGUGCCUCCNN | sense | 1113 |
| 272 | GGAGGCACAAUUAGACCAGNN | antis | 1113 |
| 273 | CACAAGAGGGACUGUAUUUNN | sense | 1174 |
| 274 | AAAUACAGUCCCUCUUGUGNN | antis | 1174 |
| 275 | UCUUGUCUCACUUUGGACUNN | sense | 1735 |
| 276 | AGUCCAAAGUGAGACAAGANN | antis | 1735 |
| 277 | UUUUCUAUGGAGCAAAACANN | sense | 1450 |
| 278 | UGUUUUGCUCCAUAGAAAANN | antis | 1450 |
| 279 | AUUUAAACUAUUCAGAGGANN | sense | 1285 |
| 280 | UCCUCUGAAUAGUUUAAAUNN | antis | 1285 |
| 281 | UUUAGAACAAUUAUCACAUNN | sense | 804 |
| 282 | AUGUGAUAAUUGUUCUAAANN | antis | 804 |
| 283 | GGAGUCCUUUCUUUUGAAANN | sense | 1866 |
| 284 | UUUCAAAAGAAAGGACUCCNN | antis | 1866 |
| 285 | UUAAGCCAUCAUCAGCUUANN | sense | 1610 |
| 286 | UAAGCUGAUGAUGGCUUAANN | antis | 1610 |
| 287 | UCUAAUUGUGCCUCCUAGNN | sense | 1117 |
| 288 | UCUAGGAGGCACAAUUAGANN | antis | 1117 |
| 289 | AAGUACAGUCCCAGCACAUNN | sense | 1320 |
| 290 | AUGUGCUGGGACUGUACUUNN | antis | 1320 |
| 291 | CUGAAGUACAGUCCCAGCANN | sense | 1317 |
| 292 | UGCUGGGACUGUACUUCAGNN | antis | 1317 |

TABLE 2c

GNAQ (human and monkey): sense and antisense sequences with dTdT overhangs Numbering for target sequences is based on Human GNAQ NM_002072

| SEQ ID NO | SEQUENCE (5'-3') | Strand | Start of target sequence |
|---|---|---|---|
| 293 | CUAAUUUAUUGCCGUCCUGdTdT | sense | 1217 |
| 294 | CAGGACGGCAAUAAAUUAGdTdT | antis | 1217 |
| 295 | AAUACUAAUUUAUUGCCGUdTdT | sense | 1213 |
| 296 | ACGGCAAUAAAUUAGUAUUdTdT | antis | 1213 |
| 297 | CAGCCAUAGCUUGAUUGCUdTdT | sense | 1810 |
| 298 | AGCAAUCAAGCUAUGGCUGdTdT | antis | 1810 |
| 299 | GUCAGGACACAUCGUUCGAdTdT | sense | 1590 |
| 300 | UCGAACGAUGUGUCCUGACdTdT | antis | 1590 |
| 301 | CUUCCCUGGUGGGCUAUUGdTdT | sense | 1149 |
| 302 | CAAUAGCCCACCAGGGAAGdTdT | antis | 1149 |
| 303 | GACACUACAUUACCCUAAUdTdT | sense | 1971 |
| 304 | AUUAGGGUAAUGUAGUGUCdTdT | antis | 1971 |
| 305 | ACUCUGUGUGAGCGUGUCCdTdT | sense | 1237 |
| 306 | GGACACGCUCACACAGAGUdTdT | antis | 1237 |
| 307 | CCCUGGUGGGCUAUUGAAGdTdT | sense | 1152 |
| 308 | CUUCAAUAGCCCACCAGGGdTdT | antis | 1152 |
| 309 | ACUAAUUUAUUGCCGUCCUdTdT | sense | 1216 |
| 310 | AGGACGGCAAUAAAUUAGUdTdT | antis | 1216 |
| 311 | CUCUCAAAUGAUACAGUCAdTdT | sense | 1575 |
| 312 | UGACUGUAUCAUUUGAGAGdTdT | antis | 1575 |
| 313 | AGUACAAUCUGGUCUAAUUdTdT | sense | 1105 |
| 314 | AAUUAGACCAGAUUGUACUdTdT | antis | 1105 |
| 315 | CACAAAGAUAAGACUUGUUdTdT | sense | 1407 |
| 316 | AACAAGUCUUAUCUUUGUGdTdT | antis | 1407 |
| 317 | ACAAUCUGGUCUAAUUGUGdTdT | sense | 1108 |
| 318 | CACAAUUAGACCAGAUUGUdTdT | antis | 1108 |
| 319 | CAGUCAUGCACUCACAAAGdTdT | sense | 1395 |
| 320 | CUUUGUGAGUGCAUGACUGdTdT | antis | 1395 |
| 321 | GACACAUCGUUCGAUUUAAdTdT | sense | 1595 |
| 322 | UUAAAUCGAACGAUGUGUCdTdT | antis | 1595 |
| 323 | CUGCUACCCAGAACCUUUUdTdT | sense | 1992 |
| 324 | AAAAGGUUCUGGGUAGCAGdTdT | antis | 1992 |
| 325 | UCAGCCAUAGCUUGAUUGCdTdT | sense | 1809 |
| 326 | GCAAUCAAGCUAUGGCUGAdTdT | antis | 1809 |
| 327 | AUUUAUUGCCGUCCUGGACdTdT | sense | 1220 |
| 328 | GUCCAGGACGGCAAUAAAUdTdT | antis | 1220 |
| 329 | CAAUUUGCAUAAUACUAAUdTdT | sense | 1203 |
| 330 | AUUAGUAUUAUGCAAAUUGdTdT | antis | 1203 |
| 331 | GUACAGUCCCAGCACAUUUdTdT | sense | 1322 |
| 332 | AAAUGUGCUGGGACUGUACdTdT | antis | 1322 |
| 333 | UACCUUCAGCCAUAGCUUGdTdT | sense | 1804 |

TABLE 2c-continued

GNAQ (human and monkey): sense and antisense sequences with dTdT overhangs
Numbering for target sequences is based on Human GNAQ NM_002072

| SEQ ID NO | SEQUENCE (5'-3') | Strand | Start of target sequence |
|---|---|---|---|
| 334 | CAAGCUAUGGCUGAAGGUAdTdT | antis | 1804 |
| 335 | ACAGACACUACAUUACCCUdTdT | sense | 1968 |
| 336 | AGGGUAAUGUAGUGUCUGUdTdT | antis | 1968 |
| 337 | AUACUAAUUUAUUGCCGUCdTdT | sense | 1214 |
| 338 | GACGGCAAUAAAUUAGUAUdTdT | antis | 1214 |
| 339 | GGGCUAUUGAAGAUACACAdTdT | sense | 1159 |
| 340 | UGUGUAUCUUCAAUAGCCCdTdT | antis | 1159 |
| 341 | GUUCGAUUUAAGCCAUCAUdTdT | sense | 1603 |
| 342 | AUGAUGGCUUAAAUCGAACdTdT | antis | 1603 |
| 343 | UGUGCCUCCUAGACACCCGdTdT | sense | 1123 |
| 344 | CGGGUGUCUAGGAGGCACAdTdT | antis | 1123 |
| 345 | CUGGACUCUGUGUGAGCGUdTdT | sense | 1233 |
| 346 | ACGCUCACACAGAGUCCAGdTdT | antis | 1233 |
| 347 | ACCCUCUCUUUCAAUUGCAdTdT | sense | 1930 |
| 348 | UGCAAUUGAAAGAGAGGGUdTdT | antis | 1930 |
| 349 | CAGACACUACAUUACCCUAdTdT | sense | 1969 |
| 350 | UAGGGUAAUGUAGUGUCUGdTdT | antis | 1969 |
| 351 | AAUUUAUUGCCGUCCUGGAdTdT | sense | 1219 |
| 352 | UCCAGGACGGCAAUAAAUUdTdT | antis | 1219 |
| 353 | UGUGUGAGCGUGUCCACAGdTdT | sense | 1241 |
| 354 | CUGUGGACACGCUCACACAdTdT | antis | 1241 |
| 355 | CCUGGUGGGCUAUUGAAGAdTdT | sense | 1153 |
| 356 | UCUUCAAUAGCCCACCAGGdTdT | antis | 1153 |
| 357 | ACCUUCAGCCAUAGCUUGAdTdT | sense | 1805 |
| 358 | UCAAGCUAUGGCUGAAGGUdTdT | antis | 1805 |
| 359 | GGAUGCUGAAGUACAGUCCdTdT | sense | 1312 |
| 360 | GGACUGUACUUCAGCAUCCdTdT | antis | 1312 |
| 361 | AUCCUAGUUCCAUUCUUGGdTdT | sense | 1546 |
| 362 | CCAAGAAUGGAACUAGGAUdTdT | antis | 1546 |
| 363 | UCCUAGUUCCAUUCUUGGAdTdT | sense | 1547 |
| 364 | ACCAAGAAUGGAACUAGGAdTdT | antis | 1547 |
| 365 | GGAGUACAAUCGGUCUAAUdTdT | sense | 1103 |
| 366 | UUAGACCAGAUUGUACUCCdTdT | antis | 1103 |
| 367 | CACAUUCCUCUCUAUCUUUdTdT | sense | 1334 |
| 368 | AAGAUAGAGAGGAAUGUGUdTdT | antis | 1334 |
| 369 | CACAGAGUUUGUAGUAAAUdTdT | sense | 1255 |
| 370 | AUUUACUACAAACUCUGUGdTdT | antis | 1255 |
| 371 | AACAGACACUACAUUACCCdTdT | sense | 1967 |
| 372 | GGGUAAUGUAGUGUCUGUUdTdT | antis | 1967 |
| 373 | UUCUCAGUCAUGCACUCACdTdT | sense | 1391 |
| 374 | GUGAGUGCAUGACUGAGAAdTdT | antis | 1391 |
| 375 | GUGCCUCCUAGACACCCGCdTdT | sense | 1124 |
| 376 | GCGGGUGUCUAGGAGGCACdTdT | antis | 1124 |
| 377 | AAGCCAUCAUCAGCUUAAUdTdT | sense | 1612 |
| 378 | AUUAAGCUGAUGAUGGCUUdTdT | antis | 1612 |
| 379 | CUCUCUUUCAAUUGCAGAUdTdT | sense | 1933 |
| 380 | AUCUGCAAUUGAAAGAGAGdTdT | antis | 1933 |
| 381 | ACACCAUCCUCCAGUUGAAdTdT | sense | 1078 |
| 382 | UUCAACUGGAGGAUGGUGUdTdT | antis | 1078 |
| 383 | UAUCCUAGUUCCAUUCUUGdTdT | sense | 1545 |
| 384 | CAAGAAUGGAACUAGGAUAdTdT | antis | 1545 |
| 385 | CAAUCUGGUCUAAUUGUGCdTdT | sense | 1109 |
| 386 | GCACAAUUAGACCAGAUUGdTdT | antis | 1109 |
| 387 | UCAUGCACUCACAAAGAUAdTdT | sense | 1398 |
| 388 | UAUCUUUGUGAGUGCAUGAdTdT | antis | 1398 |
| 389 | AGACACUACAUUACCCUAAdTdT | sense | 1970 |
| 390 | UUAGGGUAAUGUAGUGUCUdTdT | antis | 1970 |
| 391 | ACACAAGAGGGACUGUAUUdTdT | sense | 1173 |
| 392 | AAUACAGUCCCUCUUGUGUdTdT | antis | 1173 |
| 393 | GAUGCUGAAGUACAGUCCCdTdT | sense | 1313 |
| 394 | GGGACUGUACUUCAGCAUCdTdT | antis | 1313 |
| 395 | AGCCAUAGCUUGAUUGCUCdTdT | sense | 1811 |
| 396 | GAGCAAUCAAGCUAUGGCUdTdT | antis | 1811 |
| 397 | CACAGGAGUCCUUUCUUUUdTdT | sense | 1862 |
| 398 | AAAAGAAAGGACUCCUGUGdTdT | antis | 1862 |
| 399 | AUCGUUCGAUUUAAGCCAUdTdT | sense | 1600 |
| 400 | AUGGCUUAAAUCGAACGAUdTdT | antis | 1600 |
| 401 | UCAUCAGCUUAAUUUAAGUdTdT | sense | 1618 |
| 402 | ACUUAAAUUAAGCUGAUGAdTdT | antis | 1618 |
| 403 | AGCACAUUCCUCUCUAUCUdTdT | sense | 1332 |
| 404 | GAUAGAGAGGAAUGUGCUdTdT | antis | 1332 |

TABLE 2c-continued

GNAQ (human and monkey): sense and antisense sequences with dTdT overhangs Numbering for target sequences is based on Human GNAQ NM_002072

| SEQ ID NO | SEQUENCE (5'-3') | Strand | Start of target sequence |
|---|---|---|---|
| 405 | GUGGGCUAUUGAAGAUACAdTdT | sense | 1157 |
| 406 | UGUAUCUUCAAUAGCCCACdTdT | antis | 1157 |
| 407 | AUCAUGUAUUCCCAUCUAGdTdT | sense | 888 |
| 408 | CUAGAUGGGAAUACAUGAUdTdT | antis | 888 |
| 409 | AAAGACACACAGGAGUCCUdTdT | sense | 1855 |
| 410 | AGGACUCCUGUGUGUCUUUdTdT | antis | 1855 |
| 411 | CAAAUGAUACAGUCAGGACdTdT | sense | 1579 |
| 412 | GUCCUGACUGUAUCAUUUGdTdT | antis | 1579 |
| 413 | UUAGAACAAUUAUCACAUAdTdT | sense | 805 |
| 414 | UAUGUGAUAAUUGUUCUAAdTdT | antis | 805 |
| 415 | UCCAUUCUUGGUCAAGUUUdTdT | sense | 1554 |
| 416 | AAACUUGACCAAGAAUGGAdTdT | antis | 1554 |
| 417 | CUGGUCUAAUUGUGCCUCCdTdT | sense | 1113 |
| 418 | GGAGGCACAAUUAGACCAGdTdT | antis | 1113 |
| 419 | CACAAGAGGGACUGUAUUUdTdT | sense | 1174 |
| 420 | AAAUACAGUCCCUCUUGUGdTdT | antis | 1174 |
| 421 | UCUUGUCUCACUUUGGACUdTdT | sense | 1735 |
| 422 | AGUCCAAAGUGAGACAAGAdTdT | antis | 1735 |
| 423 | UUUUCUAUGGAGCAAAACAdTdT | sense | 1450 |
| 424 | UGUUUUGCUCCAUAGAAAAdTdT | antis | 1450 |
| 425 | AUUUAAACUAUUCAGAGGAdTdT | sense | 1285 |
| 426 | UCCUCUGAAUAGUUUAAAUdTdT | antis | 1285 |
| 427 | UUUAGAACAAUUAUCACAUdTdT | sense | 804 |
| 428 | AUGUGAUAAUUGUUCUAAAdTdT | antis | 804 |
| 429 | GGAGUCCUUUCUUUUGAAAdTdT | sense | 1866 |
| 430 | UUUCAAAAGAAAGGACUCCdTdT | antis | 1866 |
| 431 | UUAAGCCAUCAUCAGCUUAdTdT | sense | 1610 |
| 432 | UAAGCUGAUGAUGGCUUAAdTdT | antis | 1610 |
| 433 | UCUAAUUGUGCCUCCUAGAdTdT | sense | 1117 |
| 434 | UCUAGGAGGCACAAUUAGAdTdT | antis | 1117 |
| 435 | AAGUACAGUCCCAGCACAUdTdT | sense | 1320 |
| 436 | AUGUGCUGGGACUGUACUUdTdT | antis | 1320 |
| 437 | CUGAAGUACAGUCCCAGCdTdT | sense | 1317 |
| 438 | UGCUGGGACUGUACUUCAGdTdT | antis | 1317 |

TABLE 2d

GNAQ (human and monkey): modified sense and antisense strands Numbering for target sequences is based on Human GNAQ NM_002072.

| SEQUENCE (5'-3') | Strand | Start of target sequence | SEQ ID NO: |
|---|---|---|---|
| Modifications: Sense strand - all pyrimidines (U, C) are 2'OMe; antisense strand - pyrimidines adjacent to A (UA, CA) are 2'Ome; 3' end is dTdT | | | |
| cuAAuuuAuuGccGuccuGdTdT | sense | 1217 | 439 |
| cAGGACGGcAAuAAAUuAGdTdT | antis | 1217 | 440 |
| AAuAcuAAuuuAuuGccGudTdT | sense | 1213 | 441 |
| ACGGcAAuAAAUuAGuAUUdTdT | antis | 1213 | 442 |
| cAGccAuAGcuuGAuuGcudTdT | sense | 1810 | 443 |
| AGcAAUcAAGCuAUGGCUGdTdT | antis | 1810 | 444 |
| GucAGGAcAcAucGuucGAdTdT | sense | 1590 | 445 |
| UCGAACGAUGUGUCCUGACdTdT | antis | 1590 | 446 |
| cuucccuGGuGGGcuAuuGdTdT | sense | 1149 | 447 |
| cAAuAGCCcACcAGGGAAGdTdT | antis | 1149 | 448 |
| GAcAcuAcAuuAcccuAAudTdT | sense | 1971 | 449 |
| AUuAGGGuAAUGuAGUGUCdTdT | antis | 1971 | 450 |
| AcucuGuGuGAGcGuGuccdTdT | sense | 1237 | 451 |
| GGAcACGCUcAcAcAGAGUdTdT | antis | 1237 | 452 |
| cccuGGuGGGcuAuuGAAGdTdT | sense | 1152 | 453 |
| CUUcAAuAGCCcACcAGGGdTdT | antis | 1152 | 454 |
| AcuAAuuuAuuGccGuccudTdT | sense | 1216 | 455 |
| AGGACGGcAAuAAAUuAGUdTdT | antis | 1216 | 456 |
| cucucAAAuGAuAcAGucAdTdT | sense | 1575 | 457 |
| UGACUGuAUcAUUUGAGAGdTdT | antis | 1575 | 458 |
| AGuAcAAucuGGucuAAuudTdT | sense | 1105 | 459 |
| AAUuAGAccAGAUUGuACUdTdT | antis | 1105 | 460 |
| cAcAAAGAuAAGAcuuGuudTdT | sense | 1407 | 461 |
| AAcAAGUCUuAUCUUUGUGdTdT | antis | 1407 | 462 |
| AcAAucuGGucuAAuuGudTdT | sense | 1108 | 463 |
| cAcAAUuAGACcAGAUUGUdTdT | antis | 1108 | 464 |
| cAGucAuGcAcucAcAAAGdTdT | sense | 1395 | 465 |
| CUUUGUGAGUGcAUGACUGdTdT | antis | 1395 | 466 |
| GAcAcAucGuucGAuuuAAdTdT | sense | 1595 | 467 |
| UuAAAUCGAACGAUGUGUCdTdT | antis | 1595 | 468 |
| cuGcuAcccAGAAccuuuudTdT | sense | 1992 | 469 |
| AAAAGGUUCUGGGuAGcAGdTdT | antis | 1992 | 470 |
| ucAGccAuAGcuuGAuuGcdTdT | sense | 1809 | 471 |

TABLE 2d-continued

GNAQ (human and monkey): modified sense and antisense strands Numbering for target sequences is based on Human GNAQ_NM_002072.

| SEQUENCE (5'-3') | Strand | Start of target sequence | SEQ ID NO: |
|---|---|---|---|
| GcAAUcAAGCuAUGGCUGAdTdT | antis | 1809 | 472 |
| AuuuAuuGccGuccuGGAcdTdT | sense | 1220 | 473 |
| GUCcAGGACGGcAAuAAAUdTdT | antis | 1220 | 474 |
| cAAuuuGcAuAAuAcuAAudTdT | sense | 1203 | 475 |
| AUuAGuAUuAUGcAAAUUGdTdT | antis | 1203 | 476 |
| GuAcAGucccAGcAcAuuudTdT | sense | 1322 | 477 |
| AAAUGUGCUGGGACUGuACdTdT | antis | 1322 | 478 |
| uAccuucAGccAuAGcuuGdTdT | sense | 1804 | 479 |
| cAAGCuAUGGCUGAAGGuAdTdT | antis | 1804 | 480 |
| AcAGAcAcuAcAuuAcccudTdT | sense | 1968 | 481 |
| AGGGuAAUGuAGUGUCUGUdTdT | antis | 1968 | 482 |
| AuAcuAAuuuAuuGccGucdTdT | sense | 1214 | 483 |
| GACGGcAAuAAAUuAGuAUdTdT | antis | 1214 | 484 |
| GGGcuAuuGAAGAuAcAcAdTdT | sense | 1159 | 485 |
| UGUGuAUCUUcAAuAGCCCdTdT | antis | 1159 | 486 |
| GuucGAuuuAAGccAucAudTdT | sense | 1603 | 487 |
| AUGAUGGCUuAAAUCGAACdTdT | antis | 1603 | 488 |
| uGuGccuccuAGAcAcccGdTdT | sense | 1123 | 489 |
| CGGGUGUCuAGGAGGcAcAdTdT | antis | 1123 | 490 |
| cuGGAcucuGuGuGAGcGudTdT | sense | 1233 | 491 |
| ACGCUcAcAcAGAGUCcAGdTdT | antis | 1233 | 492 |
| AcccucucuuucAAuuGcAdTdT | sense | 1930 | 493 |
| UGcAAUUGAAAGAGAGGGUdTdT | antis | 1930 | 494 |
| cAGAcAcuAcAuuAcccuAdTdT | sense | 1969 | 495 |
| uAGGGuAAUGuAGUGUCUGdTdT | antis | 1969 | 496 |
| AAuuAuuGccGuccuGGAdTdT | sense | 1219 | 497 |
| UCcAGGACGGcAAuAAAUUdTdT | antis | 1219 | 498 |
| uGuGuGAGcGuGuccAcAGdTdT | sense | 1241 | 499 |
| CUGUGGAcACGCUcAcAcAdTdT | antis | 1241 | 500 |
| ccuGGuGGGcuAuuGAAGAdTdT | sense | 1153 | 501 |
| UCUUcAAuAGCCcACcAGGdTdT | antis | 1153 | 502 |
| AccuucAGccAuAGcuuGAdTdT | sense | 1805 | 503 |
| UcAAGCuAUGGCUGAAGGUdTdT | antis | 1805 | 504 |
| GGAuGcuGAAGuAcAGucCdTdT | sense | 1312 | 505 |
| GGACUGuACUUcAGcAUCCdTdT | antis | 1312 | 506 |
| AuccuAGuuccAuucuuGGdTdT | sense | 1546 | 507 |
| CcAAGAAUGGAACuAGGAUdTdT | antis | 1546 | 508 |
| uccuAGuuccAuucuuGGudTdT | sense | 1547 | 509 |
| ACcAAGAAUGGAACuAGGAdTdT | antis | 1547 | 510 |
| GGAGuAcAAucuGGucuAAdTdT | sense | 1103 | 511 |
| UuAGACcAGAUUGuACUCCdTdT | antis | 1103 | 512 |
| cAcAuuuccucucuAucuudTdT | sense | 1334 | 513 |
| AAGAuAGAGAGGAAAUGUGdTdT | antis | 1334 | 514 |
| cAcAGAGuuuGuAGuAAAAudTdT | sense | 1255 | 515 |
| AUUuACuAcAAACUCUGUGdTdT | antis | 1255 | 516 |
| AAcAGAcAcuAcAuuAcccdTdT | sense | 1967 | 517 |
| GGGuAAUGuAGUGUCUGUdTdT | antis | 1967 | 518 |
| uucucAGucAuGcAcucAcdTdT | sense | 1391 | 519 |
| GUGAGUGcAUGACUGAGAAdTdT | antis | 1391 | 520 |
| GuGccuccuAGAcAcccGcdTdT | sense | 1124 | 521 |
| GCGGGUGUCuAGGAGGcACdTdT | antis | 1124 | 522 |
| AAGccAucAucAGcuuAAudTdT | sense | 1612 | 523 |
| AUuAAGCUGAUGAUGGCUUdTdT | antis | 1612 | 524 |
| cucucuuucAAuuGcAGAudTdT | sense | 1933 | 525 |
| AUCUGcAAUUGAAAGAGAGdTdT | antis | 1933 | 526 |
| AcAccAuccuccAGuuGAAdTdT | sense | 1078 | 527 |
| UUcAACUGGAGGAUGGUGUdTdT | antis | 1078 | 528 |
| uAuccuAGuuccAuucuuGdTdT | sense | 1545 | 529 |
| cAAGAAUGGAACuAGGAuAdTdT | antis | 1545 | 530 |
| cAAucuGGucuAAuuGuGcdTdT | sense | 1109 | 531 |
| GcAcAAUuAGACcAGAUUGdTdT | antis | 1109 | 532 |
| ucAuGcAcucAcAAAGAudTdT | sense | 1398 | 533 |
| uAUCUUUGUGAGUGcAUGAdTdT | antis | 1398 | 534 |
| AGAcAcuAcAuuAcccuAAdTdT | sense | 1970 | 535 |
| UuAGGGuAAUGuAGUGUCUdTdT | antis | 1970 | 536 |
| AcAcAAGAGGGAcuGuAuudTdT | sense | 1173 | 537 |
| AAuAcAGUCCCUCUUGUGUdTdT | antis | 1173 | 538 |
| GAuGcuGAAGuAcAGucccdTdT | sense | 1313 | 539 |
| GGGACUGuACUUcAGcAUCdTdT | antis | 1313 | 540 |
| AGccAuAGcuuGAuuGcucdTdT | sense | 1811 | 541 |
| GAGcAAUcAAGCuAUGGCUdTdT | antis | 1811 | 542 |

TABLE 2d-continued

GNAQ (human and monkey): modified sense and antisense strands Numbering for target sequences is based on Human GNAQ_NM_002072.

| SEQUENCE (5'-3') | Strand | Start of target sequence | SEQ ID NO: |
|---|---|---|---|
| cAcAGGAGuccuuucuuuudTdT | sense | 1862 | 543 |
| AAAAGAAAGGACUCCUGUGdTdT | antis | 1862 | 544 |
| AucGuucGAuuuAAGccAudTdT | sense | 1600 | 545 |
| AUGGCUuAAAUCGAACGAUdTdT | antis | 1600 | 546 |
| ucAucAGcuuAuuuAAGudTdT | sense | 1618 | 547 |
| ACUuAAAUuAAGCUGAUGAdTdT | antis | 1618 | 548 |
| AGcAcAuuuccucucuAucdTdT | sense | 1332 | 549 |
| GAuAGAGAGGAAAUGUGCUdTdT | antis | 1332 | 550 |
| GuGGGcuAuuGAAGAuAcAdTdT | sense | 1157 | 551 |
| UGuAUCUUcAAuAGCCcACdTdT | antis | 1157 | 552 |
| AucAuGuAuucccAucuAGdTdT | sense | 888 | 553 |
| CuAGAUGGGAAuAcAUGAUdTdT | antis | 888 | 554 |
| AAAGAcAcAGGAGuccudTdT | sense | 1855 | 555 |
| AGGACUCCUGUGUGUCUUUdTdT | antis | 1855 | 556 |
| cAAuGAuAcAGucAGGAcdTdT | sense | 1579 | 557 |
| GUCCUGACUGuAUcAUUGdTdT | antis | 1579 | 558 |
| uuAGAAcAAuuAucAcAudTdT | sense | 805 | 559 |
| uAUGUGAuAAUUGUUCuAAdTdT | antis | 805 | 560 |
| uccAuucuuGGucAAGuudTdT | sense | 1554 | 561 |
| AAACUUGACcAAGAAUGGAdTdT | antis | 1554 | 562 |
| cuGGucuAAuuGuGccuccdTdT | sense | 1113 | 563 |
| GGAGGcAcAAUuAGAccAGdTdT | antis | 1113 | 564 |
| cAcAAGAGGGAcuGuAuuudTdT | sense | 1174 | 565 |
| AAAuAcAGUCCCUCUUGUGdTdT | antis | 1174 | 566 |
| ucuuGucucAcuuuGGAcudTdT | sense | 1735 | 567 |
| AGUCcAAAGUGAGAcAAGAdTdT | antis | 1735 | 568 |
| uuuucuAuGGAGcAAAAcAdTdT | sense | 1450 | 569 |
| UGUUUUGCUCcAuAGAAAAdTdT | antis | 1450 | 570 |
| AuuuAAAcuAuucAGAGGAdTdT | sense | 1285 | 571 |
| UCCUCUGAAuAGUUuAAAUdTdT | antis | 1285 | 572 |
| uuuAGAAcAAuuAucAcAudTdT | sense | 804 | 573 |
| AUGUGAuAAUUGUUCuAAAdTdT | antis | 804 | 574 |
| GGAGuccuuucuuuuGAAAdTdT | sense | 1866 | 575 |
| UUUcAAAAGAAAGGACUCCdTdT | antis | 1866 | 576 |
| uuAAGccAucAucAGcuudTdT | sense | 1610 | 577 |
| uAAGCUGAUGAUGGCUuAAdTdT | antis | 1610 | 578 |
| ucuAAuuGuGccuccuAGAdTdT | sense | 1117 | 579 |
| UCuAGGAGGcAcAAUuAGAdTdT | antis | 1117 | 580 |
| AAGuAcAGucccAGcAcAudTdT | sense | 1320 | 581 |
| AUGUGCUGGGACUGuACUUdTdT | antis | 1320 | 582 |
| cuGAAGuAcAGucccAGcAdTdT | sense | 1317 | 583 |
| UGCUGGGACUGuACUUcAGdTdT | antis | 1317 | 584 |

Modifications: Sense strand - all pyrimidines (U, C) are 2'OMe; antisense strand - pyrimidines adjacent to A (UA, CA) are 2'Ome; 3' end is thio (dTsdT)

| SEQUENCE (5'-3') | Strand | Start of target sequence | SEQ ID NO: |
|---|---|---|---|
| cuAAuuuAuuGccGuccuGdTsdT | sense | 1217 | 585 |
| cAGGACGGcAAuAAAUuAGdTsdT | antis | 1217 | 586 |
| AAuAcuAAuuuAuuGccGudTsdT | sense | 1213 | 587 |
| ACGGcAAuAAAUuAGuAUUdTsdT | antis | 1213 | 588 |
| cAGccAuGcuuGAuuGcudTsdT | sense | 1810 | 589 |
| AGcAAUcAAGCuAUGGCUGdTsdT | antis | 1810 | 590 |
| GucAGGAcAcAucGuucGAdTsdT | sense | 1590 | 591 |
| UCGAACGAUGUGUCCUGACdTsdT | antis | 1590 | 592 |
| cuucccuGGuGGGcuAuuGdTsdT | sense | 1149 | 593 |
| cAAuAGCCcACcAGGGAAGdTsdT | antis | 1149 | 594 |
| GAcAcuAcAuuAcccuAAudTsdT | sense | 1971 | 595 |
| AUuAGGGuAAUGuAGUGUCdTsdT | antis | 1971 | 596 |
| AcucuGuGuGAGcGuGuccdTsdT | sense | 1237 | 597 |
| GGAcACGCUcAcAcAGAGUdTsdT | antis | 1237 | 598 |
| cccuGGuGGGcuAuuGAAGdTsdT | sense | 1152 | 599 |
| CUUcAAuAGCCcACcAGGGdTsdT | antis | 1152 | 600 |
| AcuAAuuuAuuGccGuccudTsdT | sense | 1216 | 601 |
| AGGACGGcAAuAAAUuAGUdTsdT | antis | 1216 | 602 |
| cucucAAAuGAuAcAGucAdTsdT | sense | 1575 | 603 |
| UGACUGuAUcAUUUGAGAGdTsdT | antis | 1575 | 604 |
| AGuAcAAucuGGucuAAuudTsdT | sense | 1105 | 605 |
| AAUuAGACcAGAUUGuACUdTsdT | antis | 1105 | 606 |
| cAcAAAGAuAAGAcuGuudTsdT | sense | 1407 | 607 |
| AAcAAGUCUuAUCUUUGUGdTsdT | antis | 1407 | 608 |
| AcAAcuGGucuAAuuGudTsdT | sense | 1108 | 609 |
| cAcAAUuAGACcAGAUUGUdTsdT | antis | 1108 | 610 |
| cAGucAuGcAcucAcAAAGdTsdT | sense | 1395 | 611 |

TABLE 2d-continued

GNAQ (human and monkey): modified sense and antisense strands Numbering for target sequences is based on Human GNAQ_NM_002072.

| SEQUENCE (5'-3') | Strand | Start of target sequence | SEQ ID NO: |
|---|---|---|---|
| CUUUGUGAGUGcAUGACUGdTsdT | antis | 1395 | 612 |
| GAcAcAucGuucGAuuuAAdTsdT | sense | 1595 | 613 |
| UuAAAUCGAACGAUGUGUCdTsdT | antis | 1595 | 614 |
| cuGcuAcccAGAAccuuuudTsdT | sense | 1992 | 615 |
| AAAAGGUUCUGGGuAGcAGdTsdT | antis | 1992 | 616 |
| ucAGccAuAGcuuGAuuGcdTsdT | sense | 1809 | 617 |
| GcAAUcAAGCuAUGGCUGAdTsdT | antis | 1809 | 618 |
| AuuuAuuGccGuccuGGAcdTsdT | sense | 1220 | 619 |
| GUCcAGGACGGcAAuAAAUdTsdT | antis | 1220 | 620 |
| cAAuuuGcAuAAuAcuAAudTsdT | sense | 1203 | 621 |
| AUuAGuAUuAUGcAAAUUGdTsdT | antis | 1203 | 622 |
| GuAcAGucccAGcAcAuuudTsdT | sense | 1322 | 623 |
| AAAUGUGCUGGGACUGuACdTsdT | antis | 1322 | 624 |
| uAccuucAGccAuAGcuuGdTsdT | sense | 1804 | 625 |
| cAAGCuAUGGCUGAAGGuAdTsdT | antis | 1804 | 626 |
| AcAGAcAcuAcAuuAcccudTsdT | sense | 1968 | 627 |
| AGGGuAAUGuAGUGUCUGdTsdT | antis | 1968 | 628 |
| AuAcuAAuuuAuuGccGucdTsdT | sense | 1214 | 629 |
| GACGGcAAuAAAUuAGuAUdTsdT | antis | 1214 | 630 |
| GGGcuAuuGAAGAuAcAcAdTsdT | sense | 1159 | 631 |
| UGUGuAUCUUcAAuAGCCCdTsdT | antis | 1159 | 632 |
| GuucGAuuuAAGccAucAudTsdT | sense | 1603 | 633 |
| AUGAUGGCUuAAAUCGAACdTsdT | antis | 1603 | 634 |
| uGuGccuccuAGAcAcccGdTsdT | sense | 1123 | 635 |
| CGGGUGUCuAGGAGGcAcAdTsdT | antis | 1123 | 636 |
| cuGGAcucuGuGuGAGcGudTsdT | sense | 1233 | 637 |
| ACGCUcAcAcAGAGUCcAGdTsdT | antis | 1233 | 638 |
| AcccucucuuucAAuuGcAdTsdT | sense | 1930 | 639 |
| UGcAAUUGAAAGAGAGGGUdTsdT | antis | 1930 | 640 |
| cAGAcAcuAcAuuAcccuAdTsdT | sense | 1969 | 641 |
| uAGGGuAAUGuAGUGUCUGdTsdT | antis | 1969 | 642 |
| AAuuAuuGccGuccuGGAdTsdT | sense | 1219 | 643 |
| UCcAGGACGGcAAuAAAUdTsdT | antis | 1219 | 644 |
| uGuGuGAGcGuGuccAcAdTsdT | sense | 1241 | 645 |
| CUGUGGAcACGCUcAcAcAdTsdT | antis | 1241 | 646 |

TABLE 2d-continued

GNAQ (human and monkey): modified sense and antisense strands Numbering for target sequences is based on Human GNAQ_NM_002072.

| SEQUENCE (5'-3') | Strand | Start of target sequence | SEQ ID NO: |
|---|---|---|---|
| ccuGGuGGGcuAuuGAAGAdTsdT | sense | 1153 | 647 |
| UCUUcAAuAGCCcACcAGGdTsdT | antis | 1153 | 648 |
| AccuucAGccAuAGcuuGAdTsdT | sense | 1805 | 649 |
| UcAAGCuAUGGCUGAAGGUdTsdT | antis | 1805 | 650 |
| GGAuGcuGAAGuAcAGuccdTsdT | sense | 1312 | 651 |
| GGACUGuACUUcAGcAUCCdTsdT | antis | 1312 | 652 |
| AuccuAGuuccAuucuuGGdTsdT | sense | 1546 | 653 |
| CcAAGAAUGGAACuAGGAUdTsdT | antis | 1546 | 654 |
| uccuAGuuccAuucuGGUdTsdT | sense | 1547 | 655 |
| ACcAAGAAUGGAACuAGGAdTsdT | antis | 1547 | 656 |
| GGAGuAcAAucuGGucuAAdTsdT | sense | 1103 | 657 |
| UuAGACcAGAUUGuACUCCdTsdT | antis | 1103 | 658 |
| cAcAuuuccucucuAucuudTsdT | sense | 1334 | 659 |
| AAGAuAGAGAGGAAAUGUGdTsdT | antis | 1334 | 660 |
| cAcAGAGuuuGuAGuAAAudTsdT | sense | 1255 | 661 |
| AUUuAcuAcAAACUCUGUGdTsdT | antis | 1255 | 662 |
| AAcAGAcAcuAcAuuAcccdTsdT | sense | 1967 | 663 |
| GGGuAAUGuAGUGUCUGUdTsdT | antis | 1967 | 664 |
| uucucAGucAuGcAcucAcdTsdT | sense | 1391 | 665 |
| GUGAGUGcAUGACUGAGAAdTsdT | antis | 1391 | 666 |
| GuGccuccuAGAcAcccGcdTsdT | sense | 1124 | 667 |
| GCGGGUGUCuAGGAGGcACdTsdT | antis | 1124 | 668 |
| AAGccAucAucAGcuuAAudTsdT | sense | 1612 | 669 |
| AUuAAGCUGAUGAUGGCUUdTsdT | antis | 1612 | 670 |
| cucucuuucAAuuGcAGAudTsdT | sense | 1933 | 671 |
| AUCUGcAAUUGAAAGAGAGdTsdT | antis | 1933 | 672 |
| AcAccAuccuccAGuuGAAdTsdT | sense | 1078 | 673 |
| UUcAACUGGAGGAUGGUGUdTsdT | antis | 1078 | 674 |
| uAuccuAGuuccAuucuuGdTsdT | sense | 1545 | 675 |
| cAAGAAUGGAACuAGGAuAdTsdT | antis | 1545 | 676 |
| cAAucuGGucuAAuuGucdTsdT | sense | 1109 | 677 |
| GcAcAUuAGAccAGAUUGdTsdT | antis | 1109 | 678 |
| ucAGcAcucAcAAAGAuAdTsdT | sense | 1398 | 679 |
| uAUCUUUGUGAGUGcAUGAdTsdT | antis | 1398 | 680 |
| AGAcAcuAcAuuAcccuAAdTsdT | sense | 1970 | 681 |
| UuAGGGuAAUGuAGUGUCUdTsdT | antis | 1970 | 682 |

TABLE 2d-continued

GNAQ (human and monkey): modified sense and antisense strands Numbering for target sequences is based on Human GNAQ NM_002072.

| SEQUENCE (5'-3') | Strand | Start of target sequence | SEQ ID NO: |
|---|---|---|---|
| AcAcAAGAGGGAcuGuAuuudTsdT | sense | 1173 | 683 |
| AAuAcAGUCCCUCUUGUGUdTsdT | antis | 1173 | 684 |
| GAuGcuGAAGuAcAGucccdTsdT | sense | 1313 | 685 |
| GGGACUGuACUUcAGcAUCdTsdT | antis | 1313 | 686 |
| AGccAuAGcuuGAuuGcucdTsdT | sense | 1811 | 687 |
| GAGcAAUcAAGCuAUGGCUdTsdT | antis | 1811 | 688 |
| cAcAGGAGuccuuucuuuudTsdT | sense | 1862 | 689 |
| AAAAGAAAGGACUCCUGUGdTsdT | antis | 1862 | 690 |
| AucGuucGAuuuAAGccAudTsdT | sense | 1600 | 691 |
| AUGGCUuAAAUCGAACGAUdTsdT | antis | 1600 | 692 |
| ucAucAGcuuAAuuuAAGudTsdT | sense | 1618 | 693 |
| ACUuAAAUuAAGCUGAUGAdTsdT | antis | 1618 | 694 |
| AGcAcAuuuccucucuAucdTsdT | sense | 1332 | 695 |
| GAuAGAGAGGAAAUGUGCUdTsdT | antis | 1332 | 696 |
| GuGGGcuAuuGAAGAuAcAdTsdT | sense | 1157 | 697 |
| UGuAUCUUcAAuAGCCcACdTsdT | antis | 1157 | 698 |
| AucAuGuAuucccAucuAGdTsdT | sense | 888 | 699 |
| CuAGAUGGGAAuAcAUGAUdTsdT | antis | 888 | 700 |
| AAAGAcAcAGGAGuccudTsdT | sense | 1855 | 701 |
| AGGACUCCUGUGUGUCUUUdTsdT | antis | 1855 | 702 |
| cAAuGAuAcAGucAGGAcAdTsdT | sense | 1579 | 703 |
| GUCCUGACUGuAUcAUUGdTsdT | antis | 1579 | 704 |
| uuAGAAcAAuuAucAcAuAdTsdT | sense | 805 | 705 |
| uAUGUGAuAAUUGUUCuAAdTsdT | antis | 805 | 706 |
| uccAuucuuGGucAAGuuudTsdT | sense | 1554 | 707 |
| AAACUUGACcAAGAAUGGAdTsdT | antis | 1554 | 708 |
| cuGGucuAAuuGuGccuccdTsdT | sense | 1113 | 709 |
| GGAGGcAcAAUuAGACcAGdTsdT | antis | 1113 | 710 |
| cAcAAGAGGGAcuGuAuuudTsdT | sense | 1174 | 711 |
| AAAuAcAGUCCCUCUUGUGdTsdT | antis | 1174 | 712 |
| ucuuGucucAcuuuGGAcudTsdT | sense | 1735 | 713 |
| AGUCcAAAGUGAGAcAAGAdTsdT | antis | 1735 | 714 |
| uuuucuAuGGAGcAAAAcAdTsdT | sense | 1450 | 715 |
| UGUUUUGCUCcAuAGAAAAdTsdT | antis | 1450 | 716 |
| AuuuAAAcuAuucAGAGGAdTsdT | sense | 1285 | 717 |
| UCCUCUGAAuAGUUuAAAUdTsdT | antis | 1285 | 718 |
| uuuAGAAcAAuuAucAcAudTsdT | sense | 804 | 719 |
| AUGUGAuAAUUGUUCuAAAdTsdT | antis | 804 | 720 |
| GGAGuccuuucuuuuGAAAdTsdT | sense | 1866 | 721 |
| UUUcAAAAGAAAGGACUCCdTsdT | antis | 1866 | 722 |
| uuAAGccAucAucAGcuuAdTsdT | sense | 1610 | 723 |
| uAAGCUGAUGAUGGCUuAAdTsdT | antis | 1610 | 724 |
| ucuAAuuGuGccuccuAGAdTsdT | sense | 1117 | 725 |
| UCuAGGAGGcAcAAUuAGAdTsdT | antis | 1117 | 726 |
| AAGuAcAGucccAGcAcAudTsdT | sense | 1320 | 727 |
| AUGUGCUGGGACUGuACUUdTsdT | antis | 1320 | 728 |
| cuGAAGuAcAGucccAGcAdTsdT | sense | 1317 | 729 |
| UGCUGGGACUGuACUUcAGdTsdT | antis | 1317 | 730 |

Modifications: Sense strand - all pyrimidines are 2'OMe; antisense strand - pyrimidines adjacent to A (UA, CA) + U adjacent to another U (UU) or G (UG) are 2'Ome; 3' end is thio (dTsdT).

| SEQUENCE (5'-3') | Strand | Start of target sequence | SEQ ID NO: |
|---|---|---|---|
| cuAAuuuAuuGccGuccuGdTsdT | sense | 1217 | 731 |
| cAGGACGGcAAuAAAUuAGdTsdT | antis | 1217 | 732 |
| AAuAcuAAuuuAuuGccGudTsdT | sense | 1213 | 733 |
| ACGGcAAuAAAUuAGuAuUdTsdT | antis | 1213 | 734 |
| cAGccAuAGcuuGAuuGcudTsdT | sense | 1810 | 735 |
| AGcAAUcAAGCuAuGGCuGdTsdT | antis | 1810 | 736 |
| GucAGGAcAcAucGuucGAdTsdT | sense | 1590 | 737 |
| UCGAACGAuGuGUCCuGACdTsdT | antis | 1590 | 738 |
| cuucccuGGuGGGcuAuuGdTsdT | sense | 1149 | 739 |
| cAAuAGCCcACcAGGGAAGdTsdT | antis | 1149 | 740 |
| GAcAcuAcAuuAcccuAAUdTsdT | sense | 1971 | 741 |
| AUuAGGGuAAuGuAGuGUCdTsdT | antis | 1971 | 742 |
| AcucuGuGuGAGcGuGuccdTsdT | sense | 1237 | 743 |
| GGAcACGCUcAcAcAGAGUdTsdT | antis | 1237 | 744 |
| cccuGGuGGGcuAuuGAAGdTsdT | sense | 1152 | 745 |
| CuUcAAuAGCCcACcAGGGdTsdT | antis | 1152 | 746 |
| AcuAAuuuAuuGccGuccudTsdT | sense | 1216 | 747 |
| AGGACGGcAAuAAAUuAGUdTsdT | antis | 1216 | 748 |
| cucucAAAuGAuAcAGucAdTsdT | sense | 1575 | 749 |

TABLE 2d-continued

GNAQ (human and monkey): modified sense and antisense strands Numbering for target sequences is based on Human GNAQ NM_002072.

| SEQUENCE (5'-3') | Strand | Start of target sequence | SEQ ID NO: |
|---|---|---|---|
| uGACuGuAUcAuUuGAGAGdTsdT | antis | 1575 | 750 |
| AGuAcAAucuGGucuAAuudTsdT | sense | 1105 | 751 |
| AAUuAGACcAGAuuGuACUdTsdT | antis | 1105 | 752 |
| cAcAAAGAuAAGAcuuGuudTsdT | sense | 1407 | 753 |
| AAcAAGUCUuAUCuUuGuGdTsdT | antis | 1407 | 754 |
| AcAAucuGGucuAAuuGuGdTsdT | sense | 1108 | 755 |
| cAcAAUuAGACcAGAuuGUdTsdT | antis | 1108 | 756 |
| cAGucAuGcAcucAcAAAGdTsdT | sense | 1395 | 757 |
| CuUuGuGAGuGcAuGACuGdTsdT | antis | 1395 | 758 |
| GAcAcAucGuucGAuuuAAdTsdT | sense | 1595 | 759 |
| UuAAAUCGAACGAuGuGUCdTsdT | antis | 1595 | 760 |
| cuGcuAcccAGAAccuuuudTsdT | sense | 1992 | 761 |
| AAAAGGuUCuGGGuAGcAGdTsdT | antis | 1992 | 762 |
| ucAGccAuAGcuuGAuuGcdTsdT | sense | 1809 | 763 |
| GcAAUcAAGCuAuGGCuGAdTsdT | antis | 1809 | 764 |
| AuuuAuuGccGuccuGGAcdTsdT | sense | 1220 | 765 |
| GUCcAGGACGGcAAuAAAUdTsdT | antis | 1220 | 766 |
| cAAuuuGcAuAAuAcuAAudTsdT | sense | 1203 | 767 |
| AUuAGuAUuAuGcAAAuuGdTsdT | antis | 1203 | 768 |
| GuAcAGucccAGcAcAuuudTsdT | sense | 1322 | 769 |
| AAAuGCuGGGACuGuACdTsdT | antis | 1322 | 770 |
| uAccuucAGccAuAGcuuGdTsdT | sense | 1804 | 771 |
| cAAGCuAuGGCuGAAGGuAdTsdT | antis | 1804 | 772 |
| AcAGAcAcuAcAuuAcccudTsdT | sense | 1968 | 773 |
| AGGGuAAuGuAGuGUCuGdTsdT | antis | 1968 | 774 |
| AuAcuAAuuuAuuGccGucdTsdT | sense | 1214 | 775 |
| GACGGcAAuAAAuuAGuAUdTsdT | antis | 1214 | 776 |
| GGGcuAuuGAAGAuAcAcAdTsdT | sense | 1159 | 777 |
| uGuGuAUCUuCAAuAGCCCdTsdT | antis | 1159 | 778 |
| GuucGAuuuAAGccAucAudTsdT | sense | 1603 | 779 |
| AuGAuGGCUuAAAUCGAACdTsdT | antis | 1603 | 780 |
| uGuGccuccuAGAcAcccGdTsdT | sense | 1123 | 781 |
| CGGGuGUCuAGGAGGcAcdTsdT | antis | 1123 | 782 |
| cuGGAcucuGuGuGAGcGudTsdT | sense | 1233 | 783 |
| ACGCUcAcAcAGAGUCcAGdTsdT | antis | 1233 | 784 |
| AcccucucuuucAAuuGcAdTsdT | sense | 1930 | 785 |
| uGcAAuuGAAAGAGAGGGUdTsdT | antis | 1930 | 786 |
| cAGAcAcuAcAuuAcccuAdTsdT | sense | 1969 | 787 |
| uAGGGuAAuGuAGuGUCuGdTsdT | antis | 1969 | 788 |
| AAuuuAuuGccGuccuGGAdTsdT | sense | 1219 | 789 |
| UCcAGGACGGcAAuAAAuUdTsdT | antis | 1219 | 790 |
| uGuGuGAGcGuGuccAcAGdTsdT | sense | 1241 | 791 |
| CuGuGGAcACGCUcAcAcAdTsdT | antis | 1241 | 792 |
| ccuGGuGGGcuAuuGAAGAdTsdT | sense | 1153 | 793 |
| UCuUcAAuAGCCcACcAGGdTsdT | antis | 1153 | 794 |
| AccuucAGccAuAGcuuGAdTsdT | sense | 1805 | 795 |
| UcAAGCuAuGGCuGAAGGUdTsdT | antis | 1805 | 796 |
| GGAuGcuGAAGuAcAGuccdTsdT | sense | 1312 | 797 |
| GGACuGuAcUucAGcAUCCdTsdT | antis | 1312 | 798 |
| AuccuAGuuccAuucuuGGdTsdT | sense | 1546 | 799 |
| CcAAGAAuGGAACuAGGAUdTsdT | antis | 1546 | 800 |
| uccuAGuuccAuucuuGGudTsdT | sense | 1547 | 801 |
| ACcAAGAAuGGAACuAGGAdTsdT | antis | 1547 | 802 |
| GGAGuAcAAucuGGucuAAdTsdT | sense | 1103 | 803 |
| UuAGACcAGAuuGuACUCCdTsdT | antis | 1103 | 804 |
| cAcAuuuccucucuAucuudTsdT | sense | 1334 | 805 |
| AAGAuAGAGAGGAAAuGuGdTsdT | antis | 1334 | 806 |
| cAcAGAGuuuGuAGuAAAudTsdT | sense | 1255 | 807 |
| AuUuACuAcAAACUCuGuGdTsdT | antis | 1255 | 808 |
| AAcAGAcAcuAcAuuAcccdTsdT | sense | 1967 | 809 |
| GGGuAAuGuAGuGUCuGuUdTsdT | antis | 1967 | 810 |
| uucucAGucAuGcAcucAcdTsdT | sense | 1391 | 811 |
| GuGAGuGcAuGACuGAGAAdTsdT | antis | 1391 | 812 |
| GuGccuccuAGAcAcccGcdTsdT | sense | 1124 | 813 |
| GCGGGuGUCuAGGAGGcACdTsdT | antis | 1124 | 814 |
| AAGccAucAucAGcuuAAudTsdT | sense | 1612 | 815 |
| AUuAAGCuGAuGAuGGCuAdTsdT | antis | 1612 | 816 |
| cucucuuucAAuuGcAGAudTsdT | sense | 1933 | 817 |
| AUCuGcAAuuGAAAGAGAGdTsdT | antis | 1933 | 818 |
| AcAccAuccuccAGuuGAAdTsdT | sense | 1078 | 819 |
| uUcAACuGGAGGAuGGuGUdTsdT | antis | 1078 | 820 |

TABLE 2d-continued

GNAQ (human and monkey): modified sense and antisense strands Numbering for target sequences is based on Human GNAQ NM_002072.

| SEQUENCE (5'-3') | Strand | Start of target sequence | SEQ ID NO: |
|---|---|---|---|
| uAuccuAGuuccAuucuuGdTsdT | sense | 1545 | 821 |
| cAAGAAuGGAACuAGGAuAdTsdT | antis | 1545 | 822 |
| cAAucuGGucuAAuuGuGcdTsdT | sense | 1109 | 823 |
| GcAcAAUuAGAccAGAuuGdTsdT | antis | 1109 | 824 |
| ucAuGcAcucAcAAAGAuAdTsdT | sense | 1398 | 825 |
| uAUCuUuGuGAGuGcAuGAdTsdT | antis | 1398 | 826 |
| AGAcAcuAcAuuAcccuAAdTsdT | sense | 1970 | 827 |
| UuAGGGuAAuGuAGuGUCUdTsdT | antis | 1970 | 828 |
| AcAcAAGAGGGAcuGuAuudTsdT | sense | 1173 | 829 |
| AAuAcAGUCCCUCuuGuGUdTsdT | antis | 1173 | 830 |
| GAuGcuGAAGuAcAGucccdTsdT | sense | 1313 | 831 |
| GGGAcuGuAcUucAGcAUCdTsdT | antis | 1313 | 832 |
| AGccAuAGcuuGAuuGcucdTsdT | sense | 1811 | 833 |
| GAGcAAUcAAGCuAuGGCUdTsdT | antis | 1811 | 834 |
| cAcAGGAGuccuuucuuuudTsdT | sense | 1862 | 835 |
| AAAAGAAAGGACUCCuGuGdTsdT | antis | 1862 | 836 |
| AucGuucGAuuuAAGccAudTsdT | sense | 1600 | 837 |
| AuGGCUuAAAUCGAACGAUdTsdT | antis | 1600 | 838 |
| ucAucAGcuuAAuuuAAGudTsdT | sense | 1618 | 839 |
| ACUuAAAUuAAGCuGAuGAdTsdT | antis | 1618 | 840 |
| AGcAcAuuccucucuAucdTsdT | sense | 1332 | 841 |
| GAuAGAGAGGAAAuGuGCUdTsdT | antis | 1332 | 842 |
| GuGGGcuAuuGAAGAuAcAdTsdT | sense | 1157 | 843 |
| uGuAUCuUcAAuAGCCcACdTsdT | antis | 1157 | 844 |
| AucAuGuAuucccAucuAGdTsdT | sense | 888 | 845 |
| CuAGAuGGGAAuAcAuGAUdTsdT | antis | 888 | 846 |
| AAAGAcAcAcAGGAGuccudTsdT | sense | 1855 | 847 |
| AGGACUCCuGuGuGUCuUUdTsdT | antis | 1855 | 848 |
| cAAAuGAuAcAGucAGGAcdTsdT | sense | 1579 | 849 |
| GUCCuGACuGuAUcAuUuGdTsdT | antis | 1579 | 850 |
| uuAGAAcAAuuAucAcAudTsdT | sense | 805 | 851 |
| uAuGuGAuAAuuGuUCuAAdTsdT | antis | 805 | 852 |
| uccAuucuuGGucAAGuuudTsdT | sense | 1554 | 853 |
| AAACuuGACcAAGAAuGGAdTsdT | antis | 1554 | 854 |
| cuGGucuAAuuGuGccuccdTsdT | sense | 1113 | 855 |
| GGAGGcAcAAUuAGACcAGdTsdT | antis | 1113 | 856 |
| cAcAAGAGGGAcuGuAuuudTsdT | sense | 1174 | 857 |
| AAAuAcAGUCCCUCuuGuGdTsdT | antis | 1174 | 858 |
| ucuuGucucAcuuuGGAcudTsdT | sense | 1735 | 859 |
| AGUCcAAAGuGAGAcAAGAdTsdT | antis | 1735 | 860 |
| uuuucuAuGGAGcAAAAcAdTsdT | sense | 1450 | 861 |
| uGuUuuGCUCcAuAGAAAAdTsdT | antis | 1450 | 862 |
| AuuuAAAcuAuucAGAGGAdTsdT | sense | 1285 | 863 |
| UCCUCuGAAuAGuUuAAAUdTsdT | antis | 1285 | 864 |
| uuuAGAAcAAuuAucAcAudTsdT | sense | 804 | 865 |
| AuGuGAuAAuuGuUCuAAAdTsdT | antis | 804 | 866 |
| GGAGuccuuucuuuuGAAAdTsdT | sense | 1866 | 867 |
| uUUcAAAAGAAAGGACUCCdTsdT | antis | 1866 | 868 |
| uuAAGccAucAucAGcuuAdTsdT | sense | 1610 | 869 |
| uAAGCuGAuGAuGGCUuAAdTsdT | antis | 1610 | 870 |
| ucuAAuuGuGccuccuAGAdTsdT | sense | 1117 | 871 |
| UCuAGGAGGcAcAAUuAGAdTsdT | antis | 1117 | 872 |
| AAGuAcAGucccAGcAcAudTsdT | sense | 1320 | 873 |
| AuGCuGGGAcuGuAcUudTsdT | antis | 1320 | 874 |
| cuGAAGuAcAGucccAGcAdTsdT | sense | 1317 | 875 |
| uGCuGGGAcuGuAcUucAGdTsdT | antis | 1317 | 876 |

TABLE 3a

GNAQ (Human, monkey and mouse): target sequences
Numbering for target sequence is Human GNAQ NM_002072.

| Start of target sequence | SEQ ID NO. | Target sequence, sense strand (5'-3') | SEQ ID NO. | Target sequence, antisense strand (5'-3') |
|---|---|---|---|---|
| 1215 | 877 | UACUAAUUUAUUGCCGUCC | 888 | GGACGGCAAUAAAUUAGUA |
| 1217 | 878 | CUAAUUUAUUGCCGUCCUG | 889 | CAGGACGGCAAUAAAUUAG |
| 1216 | 879 | ACUAAUUUAUUGCCGUCCU | 890 | AGGACGGCAAUAAAUUAGU |
| 1322 | 880 | GUACAGUCCCAGCACAUUU | 891 | AAAUGUGCUGGGACUGUAC |
| 1220 | 881 | AUUUAUUGCCGUCCUGGAC | 892 | GUCCAGGACGGCAAUAAAU |
| 1265 | 882 | GUAGUAAAUAUUAUGAUUU | 893 | AAAUCAUAAUAUUUACUAC |
| 1218 | 883 | UAAUUUAUUGCCGUCCUGG | 894 | CCAGGACGGCAAUAAAUUA |
| 1175 | 884 | ACAAGAGGGACUGUAUUUC | 895 | GAAAUACAGUCCCUCUUGU |
| 1223 | 885 | UAUUGCCGUCCUGGACUCU | 896 | AGAGUCCAGGACGGCAAUA |
| 1319 | 886 | GAAGUACAGUCCCAGCACA | 897 | UGUGCUGGGACUGUACUUC |
| 1285 | 887 | AUUUAAACUAUUCAGAGGA | 898 | UCCUCUGAAUAGUUUAAAU |

TABLE 3b

GNAQ (Human, monkey and mouse): sense and antisense sequences with 2 base overhangs
Numbering for target sequence is Human GNAQ NM_002072.

| SEQ ID NO | SEQUENCE (5'-3') | Strand | Start of target sequence |
|---|---|---|---|
| 899 | UACUAAUUUAUUGCCGUCCNN | sense | 1215 |
| 900 | GGACGGCAAUAAAUUAGUANN | antis | 1215 |
| 901 | CUAAUUUAUUGCCGUCCUGNN | sense | 1217 |
| 902 | CAGGACGGCAAUAAAUUAGNN | antis | 1217 |
| 903 | ACUAAUUUAUUGCCGUCCUNN | sense | 1216 |
| 904 | AGGACGGCAAUAAAUUAGUNN | antis | 1216 |
| 905 | GUACAGUCCCAGCACAUUUNN | sense | 1322 |
| 906 | AAAUGUGCUGGGACUGUACNN | antis | 1322 |
| 907 | AUUUAUUGCCGUCCUGGACNN | sense | 1220 |
| 908 | GUCCAGGACGGCAAUAAAUNN | antis | 1220 |
| 909 | GUAGUAAAUAUUAUGAUUUNN | sense | 1265 |
| 910 | AAAUCAUAAUAUUUACUACNN | antis | 1265 |
| 911 | UAAUUUAUUGCCGUCCUGGNN | sense | 1218 |
| 912 | CCAGGACGGCAAUAAAUUANN | antis | 1218 |
| 913 | ACAAGAGGGACUGUAUUUCNN | sense | 1175 |
| 914 | GAAAUACAGUCCCUCUUGUNN | antis | 1175 |
| 915 | UAUUGCCGUCCUGGACUCUNN | sense | 1223 |
| 916 | AGAGUCCAGGACGGCAAUANN | antis | 1223 |
| 917 | GAAGUACAGUCCCAGCACANN | sense | 1319 |
| 918 | UGUGCUGGGACUGUACUUCNN | antis | 1319 |
| 919 | AUUUAAACUAUUCAGAGGANN | sense | 1285 |
| 920 | UCCUCUGAAUAGUUUAAAUNN | antis | 1285 |

TABLE 3c

GNAQ (Human, monkey and mouse): sense and antisense sequences with dTdT overhangs
Numbering for target sequence is Human GNAQ NM_002072.

| SEQ ID NO | SEQUENCE (5'-3') | Strand | Start of target sequence |
|---|---|---|---|
| 921 | UACUAAUUUAUUGCCGUCCdTdT | sense | 1215 |
| 922 | GGACGGCAAUAAAUUAGUAdTdT | antis | 1215 |
| 923 | CUAAUUUAUUGCCGUCCUGdTdT | sense | 1217 |
| 924 | CAGGACGGCAAUAAAUUAGdTdT | antis | 1217 |
| 925 | ACUAAUUUAUUGCCGUCCUdTdT | sense | 1216 |
| 926 | AGGACGGCAAUAAAUUAGUdTdT | antis | 1216 |
| 927 | GUACAGUCCCAGCACAUUUdTdT | sense | 1322 |
| 928 | AAAUGUGCUGGGACUGUACdTdT | antis | 1322 |
| 929 | AUUUAUUGCCGUCCUGGACdTdT | sense | 1220 |

TABLE 3c-continued

GNAQ (Human, monkey and mouse): sense and antisense sequences with dTdT overhangs Numbering for target sequence is Human GNAQ NM_002072.

| SEQ ID NO | SEQUENCE (5'-3') | Strand | Start of target sequence |
|---|---|---|---|
| 930 | GUCCAGGACGGcAAUAAAUdTdT | antis | 1220 |
| 931 | GUAGUAAAUAUUAUGAUUUdTdT | sense | 1265 |
| 932 | AAAUCAUAAUAUUUACUACdTdT | antis | 1265 |
| 933 | UAAUUUAUUGCCGUCCUGGdTdT | sense | 1218 |
| 934 | CCAGGACGGCAAUAAAUUAdTdT | antis | 1218 |
| 935 | ACAAGAGGGACUGUAUUUCdTdT | sense | 1175 |
| 936 | GAAAUACAGUCCCUCUUGUdTdT | antis | 1175 |
| 937 | UAUUGCCGUCCUGGACUCUdTdT | sense | 1223 |
| 938 | AGAGUCCAGGACGGCAAUAdTdT | antis | 1223 |
| 939 | GAAGUACAGUCCCAGCACAdTdT | sense | 1319 |
| 940 | UGUGCUGGGACUGUACUUCdTdT | antis | 1319 |
| 941 | AUUUAAACUAUUCAGAGGAdTdT | sense | 1285 |
| 942 | UCCUCUGAAUAGUUUAAAUdTdT | antis | 1285 |

TABLE 3d

GNAQ (Human, monkey and mouse): modified sense and antisense strands Numbering for target sequence is Human GNAQ NM_002072.

| SEQUENCE (5'-3') | Strand | Start of target sequence | SEQ ID NO |
|---|---|---|---|
| Modifications: Sense strand - all pyrimidines (U, C) are 2'OMe; antisense strand - pyrimidines adjacent to A (UA, CA) are 2'Ome; 3' end is dTdT | | | |
| uAcuAAuuuAuuGccGuccdTdT | sense | 1215 | 943 |
| GGACGGcAAuAAAUuAGuAdTdT | antis | 1215 | 944 |
| cuAAuuuAuuGccGuccuGdTdT | sense | 1217 | 945 |
| cAGGACGGcAAuAAAUuAGdTdT | antis | 1217 | 946 |
| AcuAAuuuAuuGccGuccudTdT | sense | 1216 | 947 |
| AGGACGGcAAuAAAUuAGUdTdT | antis | 1216 | 948 |
| GuAcAGucccAGcAcAuuudTdT | sense | 1322 | 949 |
| AAAUGUGCUGGGACUGuACdTdT | antis | 1322 | 950 |
| AuuuAuuGccGuccuGGAcdTdT | sense | 1220 | 951 |
| GUCcAGGACGGcAAuAAAUdTdT | antis | 1220 | 952 |
| GuAGuAAAuAuuAuGAuuudTdT | sense | 1265 | 953 |
| AAAUcAuAAuAUUuACuACdTdT | antis | 1265 | 954 |
| uAAuuuAuuGccGuccuGGdTdT | sense | 1218 | 955 |

TABLE 3d-continued

GNAQ (Human, monkey and mouse): modified sense and antisense strands Numbering for target sequence is Human GNAQ NM_002072.

| SEQUENCE (5'-3') | Strand | Start of target sequence | SEQ ID NO |
|---|---|---|---|
| CcAGGACGGcAAuAAAUuAdTdT | antis | 1218 | 956 |
| AcAAGAGGGAcuGuAuuucdTdT | sense | 1175 | 957 |
| GAAAuAcAGUCCCUCUUGUdTdT | antis | 1175 | 958 |
| uAuuGccGuccuGGAcucudTdT | sense | 1223 | 959 |
| AGAGUCcAGGACGGcAAuAdTdT | antis | 1223 | 960 |
| GAAGuAcAGucccAGcAcAdTdT | sense | 1319 | 961 |
| UGUGCUGGGACUGuACUUCdTdT | antis | 1319 | 962 |
| AuuuAAAcuAuucAGAGGAdTdT | sense | 1285 | 963 |
| UCCUCUGAAuAGUUuAAAUdTdT | antis | 1285 | 964 |
| Modifications: Sense strand - all pyrimidines (U, C) are 2'OMe; antisense strand - pyrimidines adjacent to A (UA, CA) are 2'Ome; 3' end is thio (dTsdT) | | | |
| uAcuAAuuuAuuGccGuccdTsdT | sense | 1215 | 965 |
| GGACGGcAAuAAAUuAGuAdTsdT | antis | 1215 | 966 |
| cuAAuuuAuuGccGuccuGdTsdT | sense | 1217 | 967 |
| cAGGACGGcAAuAAAUuAGdTsdT | antis | 1217 | 968 |
| AcuAAuuuAuuGccGuccudTsdT | sense | 1216 | 969 |
| AGGACGGcAAuAAAUuAGUdTsdT | antis | 1216 | 970 |
| GuAcAGucccAGcAcAuuudTsdT | sense | 1322 | 971 |
| AAAUGUGCUGGGACUGuACdTsdT | antis | 1322 | 972 |
| AuuuAuuGccGuccuGGAcdTsdT | sense | 1220 | 973 |
| GUCcAGGACGGcAAuAAAUdTsdT | antis | 1220 | 974 |
| GuAGuAAAuAuuAuGAuuudTsdT | sense | 1265 | 975 |
| AAAUcAuAAuAUUuACuACdTsdT | antis | 1265 | 976 |
| uAAuuuAuuGccGuccuGGdTsdT | sense | 1218 | 977 |
| CcAGGACGGcAAuAAAUuAdTsdT | antis | 1218 | 978 |
| AcAAGAGGGAcuGuAuuucdTsdT | sense | 1175 | 979 |
| GAAAuAcAGUCCCUCUUGUdTsdT | antis | 1175 | 980 |
| uAuuGccGuccuGGAcucudTsdT | sense | 1223 | 981 |
| AGAGUCcAGGACGGcAAuAdTsdT | antis | 1223 | 982 |
| GAAGuAcAGucccAGcAcAdTsdT | sense | 1319 | 983 |
| UGUGCUGGGACUGuACUUCdTsdT | antis | 1319 | 984 |
| AuuuAAAcuAuucAGAGGAdTsdT | sense | 1285 | 985 |
| UCCUCUGAAuAGUUuAAAUdTsdT | antis | 1285 | 986 |

TABLE 3d-continued

GNAQ (Human, monkey and mouse): modified sense and antisense strands Numbering for target sequence is Human GNAQ NM_002072.

Modifications: Sense strand - all pyrimidines are 2'OMe; antisense strand - pyrimidines adjacent to A (UA, CA) + U adjacent to another U (UU) or G (UG) are 2'Ome; 3' end is thio (dTsdT).

| SEQUENCE (5'-3') | Strand | Start of target sequence | SEQ ID NO |
|---|---|---|---|
| uAcuAAuuuAuuGccGuccdTsdT | sense | 1215 | 987 |
| GGACGGcAAuAAAUuAGuAdTsdT | antis | 1215 | 988 |
| cuAAuuuAuuGccGuccuGdTsdT | sense | 1217 | 989 |
| cAGGACGGcAAuAAAUuAGdTsdT | antis | 1217 | 990 |
| AcuAAuuuAuuGccGuccudTsdT | sense | 1216 | 991 |
| AGGACGGcAAuAAAUuAGUdTsdT | antis | 1216 | 992 |
| GuAcAGucccAGcAcAuuudTsdT | sense | 1322 | 993 |
| AAAuGuCuGGGACuGuACdTsdT | antis | 1322 | 994 |
| AuuuAuuGccGuccuGGAcdTsdT | sense | 1220 | 995 |
| GUCcAGGACGGcAAuAAAUdTsdT | antis | 1220 | 996 |
| GuAGuAAAuAuuAuGAuuudTsdT | sense | 1265 | 997 |
| AAAUcAuAAuAuUuACuACdTsdT | antis | 1265 | 998 |
| uAAuuuAuuGccGuccuGGdTsdT | sense | 1218 | 999 |
| CcAGGACGGcAAuAAAUuAdTsdT | antis | 1218 | 1000 |
| AcAAGAGGGAcuGuAuuucdTsdT | sense | 1175 | 1001 |
| GAAAuAcAGUCCCUCuuGUdTsdT | antis | 1175 | 1002 |
| uAuuGccGuccuGGAcucudTsdT | sense | 1223 | 1003 |
| AGAGUCcAGGACGGcAAuAdTsdT | antis | 1223 | 1004 |
| GAAGuAcAGucccAGcAcAdTsdT | sense | 1319 | 1005 |
| uGuGCuGGGACuGuACuUCdTsdT | antis | 1319 | 1006 |
| AuuuAAAcuAuucAGAGGAdTsdT | sense | 1285 | 1007 |
| UCCUCuGAAuAGuUuAAAUdTsdT | antis | 1285 | 1008 |

TABLE 4a

GNAQ (rat and mouse): target sequences Numbering for target sequences is Rat GNAQ NM_031036.

| Start of target sequence | SEQ ID NO. | Target sequence, sense strand (5'-3') | SEQ ID NO. | Target sequence, antisense strand (5'-3') |
|---|---|---|---|---|
| 853 | 1009 | UAUUCCCACCUAGUCGACU | 1039 | AGUCGACUAGGUGGGAAUA |
| 855 | 1010 | UUCCCACCUAGUCGACUAC | 1040 | GUAGUCGACUAGGUGGGAA |
| 367 | 1011 | GCUUUUGAGAAUCCAUAUG | 1041 | CAUAUGGAUUCUCAAAAGC |
| 55 | 1012 | CGGAGGAUCAACGACGAGA | 1042 | UCUCGUCGUUGAUCCUCCG |
| 459 | 1013 | AUCUGACUCUACCAAAUAC | 1043 | GUAUUUGGUAGAGUCAGAU |
| 312 | 1014 | ACACAAUAAGGCUCAUGCA | 1044 | UGCAUGAGCCUUAUUGUGU |
| 178 | 1015 | AGGAUCAUCCACGGGUCGG | 1045 | CCGACCCGUGGAUGAUCCU |
| 297 | 1016 | CCCAUACAAGUAUGAACAC | 1046 | GUGUUCAUACUUGUAUGGG |
| 315 | 1017 | CAAUAAGGCUCAUGCACAA | 1047 | UUGUGCAUGAGCCUUAUUG |
| 58 | 1018 | AGGAUCAACGACGAGAUCG | 1048 | CGAUCUCGUCGUUGAUCCU |
| 324 | 1019 | UCAUGCACAAUUGGUUCGA | 1049 | UCGAACCAAUUGUGCAUGA |
| 59 | 1020 | GGAUCAACGACGAGAUCGA | 1050 | UCGAUCUCGUCGUUGAUCC |
| 398 | 1021 | AGAGCUUGUGGAAUGAUCC | 1051 | GGAUCAUUCCACAAGCUCU |
| 57 | 1022 | GAGGAUCAACGACGAGAUC | 1052 | GAUCUCGUCGUUGAUCCUC |
| 56 | 1023 | GGAGGAUCAACGACGAGAU | 1053 | AUCUCGUCGUUGAUCCUCC |
| 369 | 1024 | UUUUGAGAAUCCAUAUGUA | 1054 | UACAUAUGGAUUCUCAAAA |
| 45 | 1025 | CAAGGAAGCCCGGAGGAUC | 1055 | GAUCCUCCGGGCUUCCUUG |
| 460 | 1026 | UCUGACUCUACCAAAUACU | 1056 | AGUAUUUGGUAGAGUCAGA |

TABLE 4a-continued

GNAQ (rat and mouse): target sequences
Numbering for target sequences is Rat GNAQ NM_031036.

| Start of target sequence | SEQ ID NO. | Target sequence, sense strand (5'-3') | SEQ ID NO. | Target sequence, antisense strand (5'-3') |
|---|---|---|---|---|
| 97 | 1027 | AAGCGCGACGCCCGCCGGG | 1057 | CCCGGCGGGCGUCGCGCUU |
| 314 | 1028 | ACAAUAAGGCUCAUGCACA | 1058 | UGUGCAUGAGCCUUAUUGU |
| 318 | 1029 | UAAGGCUCAUGCACAAUUG | 1059 | CAAUUGUGCAUGAGCCUUA |
| 50 | 1030 | AAGCCCGGAGGAUCAACGA | 1060 | UCGUUGAUCCUCCGGGCUU |
| 323 | 1031 | CUCAUGCACAAUUGGUUCG | 1061 | CGAACCAAUUGUGCAUGAG |
| 327 | 1032 | UGCACAAUUGGUUCGAGAG | 1062 | CUCUCGAACCAAUUGUGCA |
| 329 | 1033 | CACAAUUGGUUCGAGAGGU | 1063 | ACCUCUCGAACCAAUUGUG |
| 862 | 1034 | CUAGUCGACUACUUCCCAG | 1064 | CUGGGAAGUAGUCGACUAG |
| 89 | 1035 | GCAGGGACAAGCGCGACGC | 1065 | GCGUCGCGCUUGUCCCUGC |
| 371 | 1036 | UUGAGAAUCCAUAUGUAGA | 1066 | UCUACAUAUGGAUUCUCAA |
| 868 | 1037 | GACUACUUCCCAGAAUAUG | 1067 | CAUAUUCUGGGAAGUAGUC |
| 62 | 1038 | UCAACGACGAGAUCGAGCG | 1068 | CGCUCGAUCUCGUCGUUGA |

TABLE 4b

GNAQ (rat and mouse): sense and antisense sequences with 2 base overhangs
Numbering for target sequences is Rat GNAQ NM_031036.

| SEQ ID NO | SEQUENCE (5'-3') | Type | Start of target sequence |
|---|---|---|---|
| 1069 | UAUUCCCACCUAGUCGACUNN | sense | 853 |
| 1070 | AGUCGACUAGGUGGGAAUANN | antis | 853 |
| 1071 | UUCCCACCUAGUCGACUACNN | sense | 855 |
| 1072 | GUAGUCGACUAGGUGGGAANN | antis | 855 |
| 1073 | GCUUUGAGAAUCCAUAUGNN | sense | 367 |
| 1074 | CAUAUGGAUUCUCAAAAGCNN | antis | 367 |
| 1075 | CGGAGGAUCAACGACGAGANN | sense | 55 |
| 1076 | UCUCGUCGUUGAUCCUCCGNN | antis | 55 |
| 1077 | AUCUGACUCUACCAAAUACNN | sense | 459 |
| 1078 | GUAUUUGGUAGAGUCAGAUNN | antis | 459 |
| 1079 | ACACAAUAAGGCUCAUGCANN | sense | 312 |
| 1080 | UGCAUGAGCCUUAUUGUGUNN | antis | 312 |
| 1081 | AGGAUCAUCCACGGGUCGGNN | sense | 178 |
| 1082 | CCGACCCGUGGAUGAUCCUNN | antis | 178 |
| 1083 | CCCAUACAAGUAUGAACACNN | sense | 297 |
| 1084 | GUGUUCAUACUUGUAUGGGNN | antis | 297 |
| 1085 | CAAUAAGGCUCAUGCACAANN | sense | 315 |
| 1086 | UUGUGCAUGAGCCUUAUUGNN | antis | 315 |
| 1087 | AGGAUCAACGACGAGAUCGNN | sense | 58 |
| 1088 | CGAUCUCGUCGUUGAUCCUNN | antis | 58 |
| 1089 | UCAUGCACAAUUGGUUCGANN | sense | 324 |
| 1090 | UCGAACCAAUUGUGCAUGANN | antis | 324 |
| 1091 | GGAUCAACGACGAGAUCGANN | sense | 59 |
| 1092 | UCGAUCUCGUCGUUGAUCCNN | antis | 59 |
| 1093 | AGAGCUUGUGGAAUGAUCCNN | sense | 398 |
| 1094 | GGAUCAUUCCACAAGCUCUNN | antis | 398 |
| 1095 | GAGGAUCAACGACGAGAUCNN | sense | 57 |
| 1096 | GAUCUCGUCGUUGAUCCUCNN | antis | 57 |
| 1097 | GGAGGAUCAACGACGAGAUNN | sense | 56 |
| 1098 | AUCUCGUCGUUGAUCCUCCNN | antis | 56 |
| 1099 | UUUUGAGAAUCCAUAUGUANN | sense | 369 |
| 1100 | UACAUAUGGAUUCUCAAAANN | antis | 369 |
| 1101 | CAAGGAAGCCCGGAGGAUCNN | sense | 45 |
| 1102 | GAUCCUCCGGGCUUCCUUGNN | antis | 45 |

TABLE 4b-continued

GNAQ (rat and mouse): sense and antisense sequences with 2 base overhangs
Numbering for target sequences is Rat GNAQ NM_031036.

| SEQ ID NO | SEQUENCE (5'-3') | Type | Start of target sequence |
|---|---|---|---|
| 1103 | UCUGACUCUACCAAAUACUNN | sense | 460 |
| 1104 | AGUAUUUGGUAGAGUCAGANN | antis | 460 |
| 1105 | AAGCGCGACGCCCGCCGGGNN | sense | 97 |
| 1106 | CCCGGCGGGCGUCGCGCUUNN | antis | 97 |
| 1107 | ACAAUAAGGCUCAUGCACANN | sense | 314 |
| 1108 | UGUGCAUGAGCCUUAUUGUNN | antis | 314 |
| 1109 | UAAGGCUCAUGCACAAUUGNN | sense | 318 |
| 1110 | CAAUUGUGCAUGAGCCUUANN | antis | 318 |
| 1111 | AAGCCCGGAGGAUCAACGANN | sense | 50 |
| 1112 | UCGUUGAUCCUCCGGGCUUNN | antis | 50 |
| 1113 | CUCAUGCACAAUUGGUUCGNN | sense | 323 |
| 1114 | CGAACCAAUUGUGCAUGAGNN | antis | 323 |
| 1115 | UGCACAAUUGGUUCGAGAGNN | sense | 327 |
| 1116 | CUCUCGAACCAAUUGUGCANN | antis | 327 |
| 1117 | CACAAUUGGUUCGAGAGGUNN | sense | 329 |
| 1118 | ACCUCUCGAACCAAUUGUGNN | antis | 329 |
| 1119 | CUAGUCGACUACUUCCCAGNN | sense | 862 |
| 1120 | CUGGGAAGUAGUCGACUAGNN | antis | 862 |
| 1121 | GCAGGGACAAGCGCGACGCNN | sense | 89 |
| 1122 | GCGUCGCGCUUGUCCCUGCNN | antis | 89 |
| 1123 | UUGAGAAUCCAUAUGUAGANN | sense | 371 |
| 1124 | UCUACAUAUGGAUUCUCAANN | antis | 371 |
| 1125 | GACUACUUCCCAGAAUAUGNN | sense | 868 |
| 1126 | CAUAUUCUGGGAAGUAGUCNN | antis | 868 |
| 1127 | UCAACGACGAGAUCGAGCGNN | sense | 62 |
| 1128 | CGCUCGAUCUCGUCGUUGANN | antis | 62 |

TABLE 4c

GNAQ (rat and mouse): sense and antisense sequences with dTdT overhangs
Numbering for target sequences is Rat GNAQ NM_031036.

| SEQ ID NO | SEQUENCE (5'-3') | Strand | Start of target sequence |
|---|---|---|---|
| 1129 | UAUUCCCACCUAGUCGACUdTdT | sense | 853 |
| 1130 | AGUCGACUAGGUGGGAAUAdTdT | antis | 853 |
| 1131 | UUCCCACCUAGUCGACUACdTdT | sense | 855 |
| 1132 | GUAGUCGACUAGGUGGGAAdTdT | antis | 855 |
| 1133 | GCUUUUGAGAAUCCAUAUGdTdT | sense | 367 |
| 1134 | CAUAUGGAUUCUCAAAAGCdTdT | antis | 367 |
| 1135 | CGGAGGAUCAACGACGAGAdTdT | sense | 55 |
| 1136 | UCUCGUCGUUGAUCCUCCGdTdT | antis | 55 |
| 1137 | AUCUGACUCUACCAAAUACdTdT | sense | 459 |
| 1138 | GUAUUUGGUAGAGUCAGAUdTdT | antis | 459 |
| 1139 | ACACAAUAAGGCUCAUGCAdTdT | sense | 312 |
| 1140 | UGCAUGAGCCUUAUUGUGUdTdT | antis | 312 |
| 1141 | AGGAUCAUCCACGGGUCGGdTdT | sense | 178 |
| 1142 | CCGACCCGUGGAUGAUCCUdTdT | antis | 178 |
| 1143 | CCCAUACAAGUAUGAACACdTdT | sense | 297 |
| 1144 | GUGUUCAUACUUGUAUGGGdTdT | antis | 297 |
| 1145 | CAAUAAGGCUCAUGCACAAdTdT | sense | 315 |
| 1146 | UUGUGCAUGAGCCUUAUUGdTdT | antis | 315 |
| 1147 | AGGAUCAACGACGAGAUCGdTdT | sense | 58 |
| 1148 | CGAUCUCGUCGUUGAUCCUdTdT | antis | 58 |
| 1149 | UCAUGCACAAUUGGUUCGAdTdT | sense | 324 |
| 1150 | UCGAACCAAUUGUGCAUGAdTdT | antis | 324 |
| 1151 | GGAUCAACGACGAGAUCGAdTdT | sense | 59 |
| 1152 | UCGAUCUCGUCGUUGAUCCdTdT | antis | 59 |
| 1153 | AGAGCUUGUGGAAUGAUCCdTdT | sense | 398 |
| 1154 | GGAUCAUUCCACAAGCUCUdTdT | antis | 398 |
| 1155 | GAGGAUCAACGACGAGAUCdTdT | sense | 57 |
| 1156 | GAUCUCGUCGUUGAUCCUCdTdT | antis | 57 |
| 1157 | GGAGGAUCAACGACGAGAUdTdT | sense | 56 |
| 1158 | AUCUCGUCGUUGAUCCUCCdTdT | antis | 56 |
| 1159 | UUUUGAGAAUCCAUAUGUAdTdT | sense | 369 |
| 1160 | UACAUAUGGAUUCUCAAAAdTdT | antis | 369 |
| 1161 | CAAGGAAGCCCGGAGGAUCdTdT | sense | 45 |
| 1162 | GAUCCUCCGGGCUUCCUUGdTdT | antis | 45 |
| 1163 | UCUGACUCUACCAAAUACUdTdT | sense | 460 |
| 1164 | AGUAUUUGGUAGAGUCAGAdTdT | antis | 460 |
| 1165 | AAGCGCGACGCCCGCCGGGdTdT | sense | 97 |
| 1166 | CCCGGCGGGCGUCGCGCUUdTdT | antis | 97 |

TABLE 4c-continued

GNAQ (rat and mouse): sense and antisense sequences with dTdT overhangs Numbering for target sequences is Rat GNAQ NM_031036.

| SEQ ID NO | SEQUENCE (5'-3') | Strand | Start of target sequence |
|---|---|---|---|
| 1167 | ACAAUAAGGCUCAUGCACAdTdT | sense | 314 |
| 1168 | UGUGCAUGAGCCUUAUUGUdTdT | antis | 314 |
| 1169 | UAAGGCUCAUGCACAAUUGdTdT | sense | 318 |
| 1170 | CAAUUGUGCAUGAGCCUUAdTdT | antis | 318 |
| 1171 | AAGCCCGGAGGAUCAACGAdTdT | sense | 50 |
| 1172 | UCGUUGAUCCUCCGGGCUUdTdT | antis | 50 |
| 1173 | CUCAUGCACAAUUGGUUCGdTdT | sense | 323 |
| 1174 | CGAACCAAUUGUGCAUGAGdTdT | antis | 323 |
| 1175 | UGCACAAUUGGUUCGAGAGdTdT | sense | 327 |
| 1176 | CUCUCGAACCAAUUGUGCAdTdT | antis | 327 |
| 1177 | CACAAUUGGUUCGAGAGGUdTdT | sense | 329 |
| 1178 | ACCUCUCGAACCAAUUGUGdTdT | antis | 329 |
| 1179 | CUAGUCGACUACUUCCCAGdTdT | sense | 862 |
| 1180 | CUGGGAAGUAGUCGACUAGdTdT | antis | 862 |
| 1181 | GCAGGGACAAGCGCGACGCdTdT | sense | 89 |
| 1182 | GCGUCGCGCUUGUCCCUGCdTdT | antis | 89 |
| 1183 | UUGAGAAUCCAUAUGUAGAdTdT | sense | 371 |
| 1184 | UCUACAUAUGGAUUCUCAAdTdT | antis | 371 |
| 1185 | GACUACUUCCCAGAAUAUGdTdT | sense | 868 |
| 1186 | CAUAUUCUGGGAAGUAGUCdTdT | antis | 868 |
| 1187 | UCAACGACGAGAUCGAGCGdTdT | sense | 62 |
| 1188 | CGCUCGAUCUCGUCGUUGAdTdT | antis | 62 |

TABLE 4d

GNAQ dsRNA (rat and mouse): modified sense and antisense strands Numbering for target sequences is Rat GNAQ NM_031036.

| SEQUENCE (5'-3') | Strand | Start of target sequence | SEQ ID NO: |
|---|---|---|---|
| Modifications: Sense strand - all pyrimidines (U, C) are 2'OMe; antisense strand - pyrimidines adjacent to A (UA, CA) are 2'Ome; 3' end is dTdT | | | |
| uAuucccAccuAGucGAcudTdT | sense | 853 | 1189 |
| AGUCGACuAGGUGGGAAuAdTdT | antis | 853 | 1190 |
| uucccAccuAGucGAcuAcdTdT | sense | 855 | 1191 |
| GuAGUCGACuAGGUGGGAAdTdT | antis | 855 | 1192 |
| GcuuuuGAGAAuccAuAuGdTdT | sense | 367 | 1193 |
| cAuAUGGAUUCUcAAAAGcdTdT | antis | 367 | 1194 |
| cGGAGGAucAAcGAcGAGAdTdT | sense | 55 | 1195 |
| UCUCGUCGUUGAUCCUCCGdTdT | antis | 55 | 1196 |
| AucuGAcucuAccAAAuAcdTdT | sense | 459 | 1197 |
| GuAUUUGGuAGAGUcAGAUdTdT | antis | 459 | 1198 |
| AcAcAAuAAGGcucAuGcAdTdT | sense | 312 | 1199 |
| UGcAUGAGCCUuAUUGUGUdTdT | antis | 312 | 1200 |
| AGGAucAuccAcGGGucGGdTdT | sense | 178 | 1201 |
| CCGACCCGUGGAUGAUCCUdTdT | antis | 178 | 1202 |
| cccAuAcAAGuAuGAAcAcdTdT | sense | 297 | 1203 |
| GUGUUcAuACUUGuAUGGGdTdT | antis | 297 | 1204 |
| cAAuAAGGcuAuGcAcAAdTdT | sense | 315 | 1205 |
| UUGUGcAUGAGCCUuAUUGdTdT | antis | 315 | 1206 |
| AGGAucAAcGAcGAGAucGdTdT | sense | 58 | 1207 |
| CGAUCUCGUCGUUGAUCCUdTdT | antis | 58 | 1208 |
| ucAuGcAcAAuuGGuucGAdTdT | sense | 324 | 1209 |
| UCGAAccAAUUGUGcAUGAdTdT | antis | 324 | 1210 |
| GGAucAAcGAcGAGAucGAdTdT | sense | 59 | 1211 |
| UCGAUCUCGUCGUUGAUCCdTdT | antis | 59 | 1212 |
| AGAGcuuGuGGAAuGAuccdTdT | sense | 398 | 1213 |
| GGAUcAUUCcAcAAGCUCUdTdT | antis | 398 | 1214 |
| GAGGAucAAcGAcGAGAucdTdT | sense | 57 | 1215 |
| GAUCUCGUCGUUGAUCCUCdTdT | antis | 57 | 1216 |
| GGAGGAucAAcGAcGAGAudTdT | sense | 56 | 1217 |
| AUCUCGUCGUUGAUCCUCCdTdT | antis | 56 | 1218 |
| uuuuGAGAAuccAuAuGuAdTdT | sense | 369 | 1219 |
| uAcAuAUGGAUUCUcAAAAdTdT | antis | 369 | 1220 |
| cAAGGAAGcccGGAGGAucdTdT | sense | 45 | 1221 |
| GAUCCUCCGGGCUUCCUUGdTdT | antis | 45 | 1222 |
| ucuGAcucuAccAAAuAcudTdT | sense | 460 | 1223 |
| AGuAUUUGGuAGAGUcAGAdTdT | antis | 460 | 1224 |
| AAGcGcGAcGcccGccGGGdTdT | sense | 97 | 1225 |
| CCCGGCGGGCGUCGCGCUUdTdT | antis | 97 | 1226 |
| AcAAuAAGGcucAuGcAcAdTdT | sense | 314 | 1227 |
| UGUGcAUGAGCCUuAUUGUdTdT | antis | 314 | 1228 |

TABLE 4d-continued

GNAQ dsRNA (rat and mouse): modified sense and antisense strands
Numbering for target sequences is Rat_GNAQ_NM_031036.

| SEQUENCE (5'-3') | Strand | Start of target sequence | SEQ ID NO: |
|---|---|---|---|
| uAAGGcucAuGcAcAAuuGdTdT | sense | 318 | 1229 |
| cAAUUGUGcAUGAGCCUuAdTdT | antis | 318 | 1230 |
| AAGcccGGAGGAucAAcGAdTdT | sense | 50 | 1231 |
| UCGUUGAUCCUCCGGGCUUdTdT | antis | 50 | 1232 |
| cucAuGcAcAAuuGGuucGdTdT | sense | 323 | 1233 |
| CGAACcAAUUGUGcAUGAGdTdT | antis | 323 | 1234 |
| uGcAcAAuuGGuucGAGAGdTdT | sense | 327 | 1235 |
| CUCUCGAACcAAUUGUGcAdTdT | antis | 327 | 1236 |
| cAcAAuuGGuucGAGAGGudTdT | sense | 329 | 1237 |
| ACCUCUCGAACcAAUUGUGdTdT | antis | 329 | 1238 |
| cuAGucGAcuAcuucccAGdTdT | sense | 862 | 1239 |
| CUGGGAAGuAGUCGACuAGdTdT | antis | 862 | 1240 |
| GcAGGGAcAAGcGcAcGcdTdT | sense | 89 | 1241 |
| GCGUCGCGCUUGUCCCUGCdTdT | antis | 89 | 1242 |
| uuGAGAAuccAuAuGuAGAdTdT | sense | 371 | 1243 |
| UCuAcAuAUGGAUUCUcAAdTdT | antis | 371 | 1244 |
| GAcuAcuucccAGAAuAuGdTdT | sense | 868 | 1245 |
| cAuAUUCUGGGAAGuAGUCdTdT | antis | 868 | 1246 |
| ucAAcGAcGAGAucGAGcGdTdT | sense | 62 | 1247 |
| CGCUCGAUCUCGUCGUUGAdTdT | antis | 62 | 1248 |

Modifications: Sense strand - all pyrimidines (U, C) are 2'OMe; antisense strand - pyrimidines adjacent to A (UA, CA) are 2'Ome; 3' end is thio (dTsdT)

| SEQUENCE (5'-3') | Strand | Start of target sequence | SEQ ID NO: |
|---|---|---|---|
| uAuucccAccuAGucGAcudTsdT | sense | 853 | 1249 |
| AGUCGACuAGGUGGGAAuAdTsdT | antis | 853 | 1250 |
| uucccAccuAGucGAcuAcdTsdT | sense | 855 | 1251 |
| GuAGUCGACuAGGUGGGAAdTsdT | antis | 855 | 1252 |
| GcuuuuGAGAAuccAuAuGdTsdT | sense | 367 | 1253 |
| cAuAUGGAUUCUcAAAAGCdTsdT | antis | 367 | 1254 |
| cGGAGGAucAAcGAcGAGAdTsdT | sense | 55 | 1255 |
| UCUCGUCGUUGAUCCUCCGdTsdT | antis | 55 | 1256 |
| AucuGAcucuAccAAAuAcdTsdT | sense | 459 | 1257 |
| GuAUUUGGuAGAGUcAGAUdTsdT | antis | 459 | 1258 |
| AcAcAAuAAGGcucAuGcAdTsdT | sense | 312 | 1259 |
| UGcAUGAGCCUuAUUGUGudTsdT | antis | 312 | 1260 |
| AGGAucAuccAcGGGucGGdTsdT | sense | 178 | 1261 |
| CCGACCCGUGGAUGAUCCUdTsdT | antis | 178 | 1262 |
| cccAuAcAAGuAuGAAcAcdTsdT | sense | 297 | 1263 |
| GUGUUcAuACUUGuAUGGGdTsdT | antis | 297 | 1264 |
| cAAuAAGGcucAuGcAcAAdTsdT | sense | 315 | 1265 |
| UUGUGcAUGAGCCUuAUUGdTsdT | antis | 315 | 1266 |
| AGGAucAAcGAcGAGAucGdTsdT | sense | 58 | 1267 |
| CGAUCUCGUCGUUGAUCCUdTsdT | antis | 58 | 1268 |
| ucAuGcAcAAuuGGuucGAdTsdT | sense | 324 | 1269 |
| UCGAACcAAUUGUGcAUGAdTsdT | antis | 324 | 1270 |
| GGAucAAcGAcGAGAucGAdTsdT | sense | 59 | 1271 |
| UCGAUCUCGUCGUUGAUCCdTsdT | antis | 59 | 1272 |
| AGAGcuuGuGGAAuGAuccdTsdT | sense | 398 | 1273 |
| GGAUcAUUCcAcAAGCUCUdTsdT | antis | 398 | 1274 |
| GAGGAucAAcGAcGAGAucdTsdT | sense | 57 | 1275 |
| GAUCUCGUCGUUGAUCCUCdTsdT | antis | 57 | 1276 |
| GGAGGAucAAcGAcGAGAudTsdT | sense | 56 | 1277 |
| AUCUCGUCGUUGAUCCUCCdTsdT | antis | 56 | 1278 |
| uuuuGAGAAuccAuAuGuAdTsdT | sense | 369 | 1279 |
| uAcAuAUGGAUUCUcAAAAdTsdT | antis | 369 | 1280 |
| cAAGGAAGcccGGAGGAucdTsdT | sense | 45 | 1281 |
| GAUCCUCCGGGCUUCCUUGdTsdT | antis | 45 | 1282 |
| ucuGAcucuAccAAAuAcudTsdT | sense | 460 | 1283 |
| AGuAUUUGGuAGAGUcAGAdTsdT | antis | 460 | 1284 |
| AAGcGcGAcGcccGccGGGdTsdT | sense | 97 | 1285 |
| CCCGGCGGGCGUCGCGCUUdTsdT | antis | 97 | 1286 |
| AcAAuAAGGcucAuGcAcAdTsdT | sense | 314 | 1287 |
| UGUGcAUGAGCCUuAUUGUdTsdT | antis | 314 | 1288 |
| uAAGGcucAuGcAcAAuuGdTsdT | sense | 318 | 1289 |
| cAAUUGUGcAUGAGCCUuAdTsdT | antis | 318 | 1290 |
| AAGcccGGAGGAucAAcGAdTsdT | sense | 50 | 1291 |
| UCGUUGAUCCUCCGGGCUUdTsdT | antis | 50 | 1292 |
| cucAuGcAcAAuuGGuucGdTsdT | sense | 323 | 1293 |
| CGAACcAAUUGUGcAUGAGdTsdT | antis | 323 | 1294 |
| uGcAcAAuuGGuucGAGAGdTsdT | sense | 327 | 1295 |
| CUCUCGAACcAAUUGUGcAdTsdT | antis | 327 | 1296 |

TABLE 4d-continued

GNAQ dsRNA (rat and mouse): modified sense and antisense strands
Numbering for target sequences is Rat_GNAQ_NM_031036.

| SEQUENCE (5'-3') | Strand | Start of target sequence | SEQ ID NO: |
|---|---|---|---|
| cAcAAuuGGuucGAGAGGudTsdT | sense | 329 | 1297 |
| ACCUCUCGAACcAAUUGUGdTsdT | antis | 329 | 1298 |
| cuAGucGAcuAcuucccAGdTsdT | sense | 862 | 1299 |
| CUGGGAAGuAGUCGACuAGdTsdT | antis | 862 | 1300 |
| GcAGGGAcAAGcGcGAcGcdTsdT | sense | 89 | 1301 |
| GCGUCGCGCUUGUCCCUGCdTsdT | antis | 89 | 1302 |
| uuGAGAAuccAuAuGuAGAdTsdT | sense | 371 | 1303 |
| UCuAcAuAUGGAUUCUcAAdTsdT | antis | 371 | 1304 |
| GAcuAcuucccAGAAuAuGdTsdT | sense | 868 | 1305 |
| cAuAUUCUGGGAAGuAGUCdTsdT | antis | 868 | 1306 |
| ucAAcGAcGAGAucGAGcGdTsdT | sense | 62 | 1307 |
| CGCUCGAUCUCGUCGUUGAdTsdT | antis | 62 | 1308 |

Modifications: Sense strand - all pyrimidines are 2'OMe; antisense strand - pyrimidines adjacent to A (UA, CA) + U adjacent to another U (UU) or G (UG) are 2'Ome; 3' end is thio (dTsdT).

| SEQUENCE (5'-3') | Strand | Start of target sequence | SEQ ID NO: |
|---|---|---|---|
| uAuucccAccuAGucGAcudTsdT | sense | 853 | 1309 |
| AGUCGACuAGGuGGGAAuAdTsdT | antis | 853 | 1310 |
| uucccAccuAGucGAcuAcdTsdT | sense | 855 | 1311 |
| GuAGUCGACuAGGuGGGAAdTsdT | antis | 855 | 1312 |
| GcuuuuGAGAAuccAuAuGdTsdT | sense | 367 | 1313 |
| cAuAuGGAuUCUcAAAAGCdTsdT | antis | 367 | 1314 |
| cGGAGGAucAAcGAcGAGAdTsdT | sense | 55 | 1315 |
| UCUCGUCGuuGAUCCUCCGdTsdT | antis | 55 | 1316 |
| AucuGAcucuAccAAAuAcdTsdT | sense | 459 | 1317 |
| GuAuUuGGuAGAGUcAGAUdTsdT | antis | 459 | 1318 |
| AcAcAAuAAGGcucAuGcAdTsdT | sense | 312 | 1319 |
| uGcAuGAGCCUuAuuGuGUdTsdT | antis | 312 | 1320 |
| AGGAucAuccAcGGucGGGdTsdT | sense | 178 | 1321 |
| CCGACCCGuGGAuGAUCCUdTsdT | antis | 178 | 1322 |
| cccAuAcAAGuAuGAAcAcdTsdT | sense | 297 | 1323 |
| GuGuUcAuACuuGuAuGGGdTsdT | antis | 297 | 1324 |
| cAAuAAGGcucAuGcAcAAdTsdT | sense | 315 | 1325 |
| uuGuGcAuGAGCCUuAuuGdTsdT | antis | 315 | 1326 |
| AGGAucAAcGAcGAGAucdTsdT | sense | 58 | 1327 |
| CGAUCUCGUCGuuGAUCCUdTsdT | antis | 58 | 1328 |

TABLE 4d-continued

GNAQ dsRNA (rat and mouse): modified sense and antisense strands
Numbering for target sequences is Rat_GNAQ_NM_031036.

| SEQUENCE (5'-3') | Strand | Start of target sequence | SEQ ID NO: |
|---|---|---|---|
| ucAuGcAcAAuuGGuucGAdTsdT | sense | 324 | 1329 |
| UCGAACcAAuuGuGcAuGAdTsdT | antis | 324 | 1330 |
| GGAucAAcGAcGAGAucGAdTsdT | sense | 59 | 1331 |
| UCGAUCUCGUCGuuGAUCCdTsdT | antis | 59 | 1332 |
| AGAGcuuGuGGAAuGAuccdTsdT | sense | 398 | 1333 |
| GGAUcAuUCcAcAAGCUCUdTsdT | antis | 398 | 1334 |
| GAGGAucAAcGAcGAGAucdTsdT | sense | 57 | 1335 |
| GAUCUCGUCGuuGAUCCUCdTsdT | antis | 57 | 1336 |
| GGAGGAucAAcGAcGAGAudTsdT | sense | 56 | 1337 |
| AUCUCGUCGuuGAUCCUCCdTsdT | antis | 56 | 1338 |
| uuuuGAGAAuccAuAuGuAdTsdT | sense | 369 | 1339 |
| uAcAuAuGGAuUCUcAAAAdTsdT | antis | 369 | 1340 |
| cAAGGAAGcccGGAGGAucdTsdT | sense | 45 | 1341 |
| GAUCCUCCGGGCuUCCuuGdTsdT | antis | 45 | 1342 |
| ucuGAcucuAccAAAuAcudTsdT | sense | 460 | 1343 |
| AGuAuUgGuAGAGUcAGAdTsdT | antis | 460 | 1344 |
| AAGcGcGAcGcccGccGGGdTsdT | sense | 97 | 1345 |
| CCCGGCGGGCGUCGCGCuUdTsdT | antis | 97 | 1346 |
| AcAAuAAGGcucAuGcAcAdTsdT | sense | 314 | 1347 |
| uGuGcAuGAGCCUuAuuGUdTsdT | antis | 314 | 1348 |
| uAAGGcucAuGcAcAAuuGdTsdT | sense | 318 | 1349 |
| cAAuuGuGcAuGAGCCUuAdTsdT | antis | 318 | 1350 |
| AAGcccGGAGGAucAAcGAdTsdT | sense | 50 | 1351 |
| UCGuuGAUCCUCCGGGCuUdTsdT | antis | 50 | 1352 |
| cucAuGcAcAAuuGGuucGdTsdT | sense | 323 | 1353 |
| CGAACcAAuuGuGcAuGAGdTsdT | antis | 323 | 1354 |
| uGcAcAAuuGGuucGAGAGdTsdT | sense | 327 | 1355 |
| CUCUCGAACcAAuuGuGcAdTsdT | antis | 327 | 1356 |
| cAcAAuuGGuucGAGAGGudTsdT | sense | 329 | 1357 |
| ACCUCUCGAACcAAuuGuGdTsdT | antis | 329 | 1358 |
| cuAGucGAcuAcuucccAGdTsdT | sense | 862 | 1359 |
| CuGGGAAGuAGUCGACuAGdTsdT | antis | 862 | 1360 |
| GcAGGGAcAAGcGcGAcGcdTsdT | sense | 89 | 1361 |
| GCGUCGCGCuuGUCCCuGCdTsdT | antis | 89 | 1362 |
| uuGAGAAuccAuAuGuAGAdTsdT | sense | 371 | 1363 |
| UCuAcAuAuGGAuUCUcAAdTsdT | antis | 371 | 1364 |

TABLE 4d-continued

GNAQ dsRNA (rat and mouse): modified sense
and antisense strands
Numbering for target sequences is
Rat GNAQ NM_031036.

| SEQUENCE (5'-3') | Strand | Start of target sequence | SEQ ID NO: |
|---|---|---|---|
| GAcuAcuucccAGAAuAuGdTsdT | sense | 868 | 1365 |
| cAuAuUCuGGGAAGuAGUCdTsdT | antis | 868 | 1366 |
| ucAAcGAcGAGAucGAGcGdTsdT | sense | 62 | 1367 |
| CGCUCGAUCUCGUCGuuGAdTsdT | antis | 62 | 1368 |

Example 3

In vitro screening

For in vitro screening, cells expressing GNAQ were utilized. Some exemplary cell lines expressing GNAQ include, but are not limited to, human melanoma cell lines OMM1.3 and MEL 285, and Mel 202. OMM1.3 are liver metastisis cells that include a mutant GNAQ gene. MEL285 are primary uveal melanoma cells that include a WT GNAQ gene. MEL202 are also primary uveal melanoma but include a mutant GNAQ gene. A549 (lung carcinoma) and A375 (malignant melanoma) are cancer cell lines expressing WT GNAQ.

Cells expressing human GNAQ with the activating GNAQ mutation were obtained following the method outlined in PCT publication number WO2008/098208, which is incorporated herein in its entirety for all purposes.

The dsRNAs were screened for in vitro inhibition of the target gene. Tissue culture cells were transfected with the dsRNA. Target gene mRNA levels were assayed using qPCR (real time PCR).

Cell culture and transfections:

A549, A375, OMM1.3 and UMEL202 cells were grown to near confluence at 37° C. in an atmosphere of 5% $CO_2$ in specific medium (ATCC) supplemented with 10% FBS, streptomycin, and glutamine (ATCC) before being released from the plate by trypsinization. Reverse transfection was carried out by adding 5 µl of Opti-MEM to 5 µl of siRNA duplexes (Tables 5-7) per well into a 96-well plate along with 10 µl of Opti-MEM plus 0.2 µl of Lipofectamine RNAiMax per well (Invitrogen, Carlsbad Calif. cat #13778-150) and incubated at room temperature for 15 minutes. 80 µl of complete growth media without antibiotics containing $2\times10^4$ cells were then added. Cells were incubated for 24 hours prior to RNA purification. Single dose experiments were performed at either 0.1 nM, 1.0 nM, or and 10.0 nM final duplex concentration and dose response experiments were done with 10, 1.66, 0.27, 0.046, 0.0077, 0.0012, 0.00021, 0.000035 nM of selected duplexes.

TABLE 5

Duplex (dsRNA) names and corresponding sample names

| Sample name | Duplex Name | ssRNA name |
|---|---|---|
| 1 | AD-20032 | 36864 |
| | | 36865 |
| 2 | AD-20033 | 36866 |
| | | 36867 |
| 3 | AD-20034 | 36868 |
| | | 36869 |
| 4 | AD-20035 | 36870 |
| | | 36871 |
| 5 | AD-20036 | 36872 |
| | | 36873 |
| 6 | AD-20037 | 36874 |
| | | 36875 |
| 7 | AD-20038 | 36876 |
| | | 36877 |
| 8 | AD-20039 | 36878 |
| | | 36879 |
| 9 | AD-20040 | 36880 |
| | | 36881 |
| 10 | AD-20041 | 36882 |
| | | 36883 |
| 11 | AD-20042 | 36884 |
| | | 36885 |
| 12 | AD-20043 | 36886 |
| | | 36887 |
| 13 | AD-20044 | 36888 |
| | | 36889 |
| 14 | AD-20045 | 36890 |
| | | 36891 |
| 15 | AD-20046 | 36892 |
| | | 36893 |
| 16 | AD-20047 | 36894 |
| | | 36895 |
| 17 | AD-20048 | 36896 |
| | | 36897 |
| 18 | AD-20049 | 36898 |
| | | 36899 |
| 19 | AD-20050 | 36900 |
| | | 36901 |
| 20 | AD-20051 | 36902 |
| | | 36903 |
| 21 | AD-20052 | 36904 |
| | | 36905 |
| 22 | AD-20053 | 36906 |
| | | 36907 |
| 23 | AD-20054 | 36910 |
| | | 36911 |
| 24 | AD-20055 | 36912 |
| | | 36913 |
| 25 | AD-20056 | 36914 |
| | | 36915 |
| 26 | AD-20057 | 36916 |
| | | 36917 |
| 27 | AD-20058 | 36918 |
| | | 36919 |
| 28 | AD-20059 | 36920 |
| | | 36921 |
| 29 | AD-20060 | 36922 |
| | | 36923 |
| 30 | AD-20061 | 36924 |
| | | 36925 |
| 31 | AD-20062 | 36926 |
| | | 36927 |
| 32 | AD-20063 | 36928 |
| | | 36929 |
| 33 | AD-20064 | 36930 |
| | | 36931 |
| 34 | AD-20065 | 36932 |
| | | 36933 |
| 35 | AD-20066 | 36934 |
| | | 36935 |
| 36 | AD-20067 | 36936 |
| | | 36937 |
| 37 | AD-20068 | 36938 |
| | | 36939 |
| 38 | AD-20069 | 36940 |
| | | 36941 |

TABLE 5-continued

Duplex (dsRNA) names and corresponding sample names

| Sample name | Duplex Name | ssRNA name |
|---|---|---|
| 39 | AD-20070 | 36942 |
|  |  | 36943 |
| 40 | AD-20071 | 36946 |
|  |  | 36947 |
| 41 | AD-20072 | 36948 |
|  |  | 36949 |
| 42 | AD-20073 | 36950 |
|  |  | 36951 |
| 43 | AD-20074 | 36954 |
|  |  | 36955 |
| 87 | AD-20075 | 36956 |
|  |  | 36957 |
| 44 | AD-20076 | 36958 |
|  |  | 36959 |
| 45 | AD-20077 | 36960 |
|  |  | 36961 |
| 46 | AD-20078 | 36962 |
|  |  | 36963 |
| 47 | AD-20079 | 36964 |
|  |  | 36965 |
| 48 | AD-20080 | 36966 |
|  |  | 36967 |
| 49 | AD-20081 | 36968 |
|  |  | 36969 |
| 50 | AD-20082 | 36970 |
|  |  | 36971 |
| 51 | AD-20083 | 36972 |
|  |  | 36973 |
| 52 | AD-20084 | 36974 |
|  |  | 36975 |
| 53 | AD-20085 | 36976 |
|  |  | 36977 |
| 54 | AD-20086 | 36978 |
|  |  | 36979 |
| 55 | AD-20087 | 36980 |
|  |  | 36981 |
| 56 | AD-20088 | 36982 |
|  |  | 36983 |
| 57 | AD-20089 | 36984 |
|  |  | 36985 |
| 58 | AD-20090 | 36986 |
|  |  | 36987 |
| 59 | AD-20091 | 36988 |
|  |  | 36989 |
| 60 | AD-20092 | 36990 |
|  |  | 36991 |
| 61 | AD-20093 | 36992 |
|  |  | 36993 |
| 62 | AD-20094 | 36994 |
|  |  | 36995 |
| 63 | AD-20095 | 36996 |
|  |  | 36997 |
| 64 | AD-20096 | 36998 |
|  |  | 36999 |
| 65 | AD-20097 | 37000 |
|  |  | 37001 |
| 88 | AD-20098 | 37002 |
|  |  | 37003 |
| 66 | AD-20099 | 37004 |
|  |  | 37005 |
| 67 | AD-20100 | 37006 |
|  |  | 37007 |
| 68 | AD-20101 | 37008 |
|  |  | 37009 |
| 69 | AD-20102 | 37010 |
|  |  | 37011 |
| 89 | AD-20103 | 37012 |
|  |  | 37013 |
| 70 | AD-20104 | 37014 |
|  |  | 37015 |
| 95 | AD-20105 | 37016 |
|  |  | 37017 |
| 71 | AD-20106 | 37018 |
|  |  | 37019 |
| 72 | AD-20107 | 37022 |
|  |  | 37023 |
| 73 | AD-20108 | 37024 |
|  |  | 37025 |
| 74 | AD-20109 | 37026 |
|  |  | 37027 |
| 75 | AD-20110 | 37032 |
|  |  | 37033 |
| 76 | AD-20111 | 37034 |
|  |  | 37035 |
| 77 | AD-20112 | 37036 |
|  |  | 37037 |
| 78 | AD-20113 | 37038 |
|  |  | 37039 |
| 79 | AD-20114 | 37040 |
|  |  | 37041 |
| 80 | AD-20115 | 37042 |
|  |  | 37043 |
| 81 | AD-20116 | 37044 |
|  |  | 37045 |
| 82 | AD-20117 | 37046 |
|  |  | 37047 |
| 83 | AD-20118 | 37048 |
|  |  | 37049 |
| 84 | AD-20119 | 37050 |
|  |  | 37051 |
| 85 | AD-20120 | 37052 |
|  |  | 37053 |
| 86 | AD-20121 | 37054 |
|  |  | 37055 |
| 91 | AD-20193 | 36908 |
|  |  | 36909 |
| 92 | AD-20194 | 36945 |
|  |  | 36944 |
| 93 | AD-20195 | 37020 |
|  |  | 37021 |
| 94 | AD-20196 | 37028 |
|  |  | 37029 |
| 95 | AD-20197 | 37030 |
|  |  | 37031 |

TABLE 6

Sequences of dsRNA targeting Human GNAQ (NM_002072.2)
(target is position of 5' base on transcript of NM_002072.2

| Duplex name | Strand | Target | SEQ ID NO: | Unmodified sequence 5' to 3' | SEQ ID NO: | Modified sequence 5' to 3' |
|---|---|---|---|---|---|---|
| AD-20032 | S | 1215 | 1369 | UACUAAUUUAUUGCCGUCC | 1527 | uAcuAAuuuAuuGccGuccdTdT |
|  | A | 1215 | 1370 | GGACGGCAAUAAAUUAGUA | 1528 | GGACGGcAAuAAAUuAGuAdTdT |
| AD-20033 | S | 1217 | 1371 | CUAAUUUAUUGCCGUCCUG | 1529 | cuAAuuuAuuGccGuccuGdTdT |
|  | A | 1217 | 1372 | CAGGACGGCAAUAAAUUAG | 1530 | cAGGACGGcAAuAAAUuAGdTdT |

TABLE 6-continued

Sequences of dsRNA targeting Human GNAQ (NM_002072.2)
(target is position of 5' base on transcript of NM_002072.2

| Duplex name | Strand | Target | SEQ ID NO: | Unmodified sequence 5' to 3' | SEQ ID NO: | Modified sequence 5' to 3' |
|---|---|---|---|---|---|---|
| AD-20034 | S | 1216 | 1373 | ACUAAUUUAUUGCCGUCCU | 1531 | AcuAAuuuAuuGccGuccudTdT |
|  | A | 1216 | 1374 | AGGACGGCAAUAAAUUAGU | 1532 | AGGACGGcAAuAAAUuAGUdTdT |
| AD-20035 | S | 1322 | 1375 | GUACAGUCCCAGCACAUUU | 1533 | GuAcAGucccAGcAcAuuudTdT |
|  | A | 1322 | 1376 | AAAUGUGCUGGGACUGUAC | 1534 | AAAUGUGCUGGGACUGuACdTdT |
| AD-20036 | S | 1220 | 1377 | AUUUAUUGCCGUCCUGGAC | 1535 | AuuuAuuGccGuccuGGAcdTdT |
|  | A | 1220 | 1378 | GUCCAGGACGGCAAUAAAU | 1536 | GUCcAGGACGGcAAuAAAUdTdT |
| AD-20037 | S | 1265 | 1379 | GUAGUAAAUAUUAUGAUUU | 1537 | GuAGuAAAuAuuAuGAuuudTdT |
|  | A | 1265 | 1380 | AAAUCAUAAUAUUUACUAC | 1538 | AAAUcAuAAuAUUuAcuACdTdT |
| AD-20038 | S | 1218 | 1381 | UAAUUUAUUGCCGUCCUGG | 1539 | uAAuuuAuuGccGuccuGGdTdT |
|  | A | 1218 | 1382 | CCAGGACGGCAAUAAAUUA | 1540 | CcAGGACGGcAAuAAAUuAdTdT |
| AD-20039 | S | 1175 | 1383 | ACAAGAGGGACUGUAUUUC | 1541 | AcAAGAGGGAcuGuAuuucdTdT |
|  | A | 1175 | 1384 | GAAAUACAGUCCCUCUUGU | 1542 | GAAAuAcAGUCCCUCUUGUdTdT |
| AD-20040 | S | 1223 | 1385 | UAUUGCCGUCCUGGACUCU | 1543 | uAuuGccGuccuGGAcucudTdT |
|  | A | 1223 | 1386 | AGAGUCCAGGACGGCAAUA | 1544 | AGAGUCcAGGACGGcAAuAdTdT |
| AD-20041 | S | 1319 | 1387 | GAAGUACAGUCCCAGCACA | 1545 | GAAGuAcAGucccAGcAcAdTdT |
|  | A | 1319 | 1388 | UGUGCUGGGACUGUACUUC | 1546 | UGUGCUGGGACUGuACUUCdTdT |
| AD-20042 | S | 1285 | 1389 | AUUUAAACUAUUCAGAGGA | 1547 | AuuuAAAcuAuucAGAGGAdTdT |
|  | A | 1285 | 1390 | UCCUCUGAAUAGUUUAAAU | 1548 | UCCUCUGAAuAGUUuAAAUdTdT |
| AD-20043 | S | 1213 | 1391 | AAUACUAAUUUAUUGCCGU | 1549 | AAuAcuAAuuuAuuGccGudTdT |
|  | A | 1213 | 1392 | ACGGCAAUAAAUUAGUAUU | 1550 | ACGGcAAuAAAUuAGuAUUdTdT |
| AD-20044 | S | 1810 | 1393 | CAGCCAUAGCUUGAUUGCU | 1551 | cAGccAuAGcuuGAuuGcudTdT |
|  | A | 1810 | 1394 | AGCAAUCAAGCUAUGGCUG | 1552 | AGcAAUcAAGCuAUGGCUGdTdT |
| AD-20045 | S | 1590 | 1395 | GUCAGGACACAUCGUUCGA | 1553 | GucAGGAcAcAucGuucGAdTdT |
|  | A | 1590 | 1396 | UCGAACGAUGUGUCCUGAC | 1554 | UCGAACGAUGUGUCCUGACdTdT |
| AD-20046 | S | 1149 | 1397 | CUUCCCUGGUGGGCUAUUG | 1555 | cuuccCuGGuGGGcuAuuGdTdT |
|  | A | 1149 | 1398 | CAAUAGCCCACCAGGGAAG | 1556 | cAAuAGCCcAccAGGGAAGdTdT |
| AD-20047 | S | 1971 | 1399 | GACACUACAUUACCCUAAU | 1557 | GAcAcuAcAuuAcccuAAudTdT |
|  | A | 1971 | 1400 | AUUAGGGUAAUGUAGUGUC | 1558 | AUuAGGGuAAUGuAGUGUCdTdT |
| AD-20048 | S | 1237 | 1401 | ACUCUGUGUGAGCGUGUCC | 1559 | AcucuGuGuGAGcGuGuccdTdT |
|  | A | 1237 | 1402 | GGACACGCUCACACAGAGU | 1560 | GGAcACGCUcAcAcAGAGUdTdT |
| AD-20049 | S | 1152 | 1403 | CCCUGGUGGGCUAUUGAAG | 1561 | cccuGGuGGGcuAuuGAAGdTdT |
|  | A | 1152 | 1404 | CUUCAAUAGCCCACCAGGG | 1562 | CUUcAAuAGCCcAccAGGGdTdT |
| AD-20050 | S | 1575 | 1405 | CUCUCAAAUGAUACAGUCA | 1563 | cucucAAAuGAuAcAGucAdTdT |
|  | A | 1575 | 1406 | UGACUGUAUCAUUUGAGAG | 1564 | UGACUGuAUcAUUUGAGAGdTdT |
| AD-20051 | S | 1105 | 1407 | AGUACAAUCUGGUCUAAUU | 1565 | AGuAcAAucuGGucuAAuudTdT |
|  | A | 1105 | 1408 | AAUUAGACCAGAUUGUACU | 1566 | AAUuAGACcAGAUUGuACUdTdT |
| AD-20052 | S | 1407 | 1409 | CACAAAGAUAAGACUUGUU | 1567 | cAcAAAGAuAAGAcuuGuudTdT |
|  | A | 1407 | 1410 | AACAAGUCUUAUCUUUGUG | 1568 | AAcAAGUCUuAUCUUUGUGdTdT |
| AD-20053 | S | 1108 | 1411 | ACAAUCGGUCUAAUUGUG | 1569 | AcAAucGGucuAAuuGuGdTdT |
|  | A | 1108 | 1412 | CACAAUUAGACCAGAUUGU | 1570 | cAcAAUuAGACcAGAUUGUdTdT |
| AD-20193 | S | 1395 | 1413 | CAGUCAUGCACUCACAAAG | 1571 | cAGucAuGcAcucAcAAAGdTdT |
|  | A | 1395 | 1414 | CUUUGUGAGUGCAUGACUG | 1572 | CUUUGUGAGUGcAUGACUGdTdT |
| AD-20054 | S | 1595 | 1415 | GACACAUCGUUCGAUUUAA | 1573 | GAcAcAucGuucGAuuuAAdTdT |
|  | A | 1595 | 1416 | UUAAAUCGAACGAUGUGUC | 1574 | UuAAAUCGAACGAUGUGUCdTdT |
| AD-20055 | S | 1992 | 1417 | CUGCUACCCAGAACCUUUU | 1575 | cuGcuAcccAGAAccuuuudTdT |
|  | A | 1992 | 1418 | AAAAGGUUCUGGGUAGCAG | 1576 | AAAAGGUUCUGGGuAGcAGdTdT |

TABLE 6-continued

Sequences of dsRNA targeting Human GNAQ (NM_002072.2)
(target is position of 5' base on transcript of NM_002072.2

| Duplex name | Strand | Target | SEQ ID NO: | Unmodified sequence 5' to 3' | SEQ ID NO: | Modified sequence 5' to 3' |
|---|---|---|---|---|---|---|
| AD-20056 | S | 1809 | 1419 | UCAGCCAUAGCUUGAUUGC | 1577 | ucAGccAuAGcuuGAuuGcdTdT |
|  | A | 1809 | 1420 | GCAAUCAAGCUAUGGCUGA | 1578 | GcAAUcAAGCuAUGGCUGAdTdT |
| AD-20057 | S | 1203 | 1421 | CAAUUUGCAUAAUACUAAU | 1579 | cAAuuuGcAuAAuAcuAAudTdT |
|  | A | 1203 | 1422 | AUUAGUAUUAUGCAAAUUG | 1580 | AUuAGuAUuAUGCAAAUUGdTdT |
| AD-20058 | S | 1804 | 1423 | UACCUUCAGCCAUAGCUUG | 1581 | uAccuucAGccAuAGcuuGdTdT |
|  | A | 1804 | 1424 | CAAGCUAUGGCUGAAGGUA | 1582 | cAAGCuAUGGCUGAAGGuAdTdT |
| AD-20059 | S | 1968 | 1425 | ACAGACACUACAUUACCCU | 1583 | AcAGAcAcuAcAuuAcccudTdT |
|  | A | 1968 | 1426 | AGGGUAAUGUAGUGUCUGU | 1584 | AGGGuAAUGuAGUGUCUGUdTdT |
| AD-20060 | S | 1214 | 1427 | AUACUAAUUUAUUGCCGUC | 1585 | AuAcuAAuuuAuuGccGucdTdT |
|  | A | 1214 | 1428 | GACGGCAAUAAAUUAGUAU | 1586 | GACGGcAAuAAAUuAGuAUdTdT |
| AD-20061 | S | 1159 | 1429 | GGGCUAUUGAAGAUACACA | 1587 | GGGcuAuuGAAGAuAcAcAdTdT |
|  | A | 1159 | 1430 | UGUGUAUCUUCAAUAGCCC | 1588 | UGUGuAUCUUcAAuAGCCCdTdT |
| AD-20062 | S | 1603 | 1431 | GUUCGAUUUAAGCCAUCAU | 1589 | GuucGAuuuAAGccAucAudTdT |
|  | A | 1603 | 1432 | AUGAUGGCUUAAAUCGAAC | 1590 | AUGAUGGCUuAAAUCGAACdTdT |
| AD-20063 | S | 1123 | 1433 | UGUGCCUCCUAGACACCCG | 1591 | uGuGccuccuAGAcAccccGdTdT |
|  | A | 1123 | 1434 | CGGGUGUCUAGGAGGCACA | 1592 | CGGGUGUCuAGGAGGcAcAdTdT |
| AD-20064 | S | 1233 | 1435 | CUGGACUCUGUGUGAGCGU | 1593 | cuGGAcucuGuGuGAGcGudTdT |
|  | A | 1233 | 1436 | ACGCUCACACAGAGUCCAG | 1594 | ACGCUcAcAcAGAGUCcAGdTdT |
| AD-20065 | S | 1930 | 1437 | ACCCUCUCUUUCAAUUGCA | 1595 | AcccucucuuucAAuuGcAdTdT |
|  | A | 1930 | 1438 | UGCAAUUGAAAGAGAGGGU | 1596 | UGcAAUUGAAAGAGAGGGUdTdT |
| AD-20066 | S | 1969 | 1439 | CAGACACUACAUUACCCUA | 1597 | cAGAcAcuAcAuuAcccuAdTdT |
|  | A | 1969 | 1440 | UAGGGUAAUGUAGUGUCUG | 1598 | uAGGGuAAUGuAGUGUCUGdTdT |
| AD-20067 | S | 1219 | 1441 | AAUUUAUUGCCGUCCUGGA | 1599 | AAuuuAuuGccGuccuGGAdTdT |
|  | A | 1219 | 1442 | UCCAGGACGGCAAUAAAUU | 1600 | UCcAGGACGGcAAuAAAUUdTdT |
| AD-20068 | S | 1241 | 1443 | UGUGUGAGCGUGUCCACAG | 1601 | uGuGuGAGcGuGuccAcAGdTdT |
|  | A | 1241 | 1444 | CUGUGGACACGCUCACACA | 1602 | CUGUGGAcACGCUcAcAcAdTdT |
| AD-20069 | S | 1153 | 1445 | CCUGGUGGGCUAUUGAAGA | 1603 | ccuGGuGGGcuAuuGAAGAdTdT |
|  | A | 1153 | 1446 | UCUUCAAUAGCCCACCAGG | 1604 | UCUUcAAuAGCCcAccAGGdTdT |
| AD-20070 | S | 1805 | 1447 | ACCUUCAGCCAUAGCUUGA | 1605 | AccuucAGccAuAGcuuGAdTdT |
|  | A | 1805 | 1448 | UCAAGCUAUGGCUGAAGGU | 1606 | UcAAGCuAUGGCUGAAGGUdTdT |
| AD-20194 | S | 1312 | 1449 | GGAUGCUGAAGUACAGUCC | 1607 | GGAuGcuGAAGuAcAGuccdTdT |
|  | A | 1312 | 1450 | GGACUGUACUUCAGCAUCC | 1608 | GGACUGuACUUcAGcAUCCdTdT |
| AD-20071 | S | 1546 | 1451 | AUCCUAGUUCCAUUCUUGG | 1609 | AuccuAGuuccAuucuuGGdTdT |
|  | A | 1546 | 1452 | CCAAGAAUGGAACUAGGAU | 1610 | CcAAGAAUGGAACuAGGAUdTdT |
| AD-20072 | S | 1547 | 1453 | UCCUAGUUCCAUUCUUGGU | 1611 | uccuAGuuccAuucuuGGudTdT |
|  | A | 1547 | 1454 | ACCAAGAAUGGAACUAGGA | 1612 | ACcAAGAAUGGAACuAGGAdTdT |
| AD-20073 | S | 1103 | 1455 | GGAGUACAAUCUGGUCUAA | 1613 | GGAGuAcAAucuGGucuAAdTdT |
|  | A | 1103 | 1456 | UUAGACCAGAUUGUACUCC | 1614 | UuAGACcAGAUUGuACUCCdTdT |
|  | A | 1334 | 1457 | CACAUUUCCUCUCUAUCUU | 1615 | cAcAuuuccucucuAucuudTdT |
|  | A | 1334 | 1458 | AAGAUAGAGAGGAAAUGUG | 1616 | AAGAuAGAGAGGAAAUGUGdTdT |
| AD-20074 | S | 1255 | 1459 | CACAGAGUUUGUAGUAAAU | 1617 | cAcAGAGuuuGuAGuAAAudTdT |
|  | A | 1255 | 1460 | AUUUACUACAAACUCUGUG | 1618 | AUUuACuAcAAACUCUGUGdTdT |
| AD-20075 | S | 1967 | 1461 | AACAGACACUACAUUACCC | 1619 | AAcAGAcAcuAcAuuAcccdTdT |
|  | A | 1967 | 1462 | GGGUAAUGUAGUGUCUGUU | 1620 | GGGuAAUGuAGUGUCUGUUdTdT |
| AD-20076 | S | 1391 | 1463 | UUCUCAGUCAUGCACUCAC | 1621 | uucucAGucAuGcAcucAcdTdT |
|  | A | 1391 | 1464 | GUGAGUGCAUGACUGAGAA | 1622 | GUGAGUGcAUGACUGAGAAdTdT |
| AD-20077 | S | 1124 | 1465 | GUGCCUCCUAGACACCCGC | 1623 | GuGccuccuAGAcAcccGcdTdT |
|  | A | 1124 | 1466 | GCGGGUGUCUAGGAGGCAC | 1624 | GCGGGUGUCuAGGAGGcACdTdT |
| AD-20078 | S | 1612 | 1467 | AAGCCAUCAUCAGCUUUAU | 1625 | AAGccAucAucAGcuuAAudTdT |
|  | A | 1612 | 1468 | AUUAAGCUGAUGAUGGCUU | 1626 | AUuAAGCUGAUGAUGGCUUdTdT |

TABLE 6-continued

Sequences of dsRNA targeting Human GNAQ (NM_002072.2)
(target is position of 5' base on transcript of NM_002072.2

| Duplex name | Strand | Target | SEQ ID NO: | Unmodified sequence 5' to 3' | SEQ ID NO: | Modified sequence 5' to 3' |
|---|---|---|---|---|---|---|
| AD-20079 | S | 1933 | 1469 | CUCUCUUUCAAUUGCAGAU | 1627 | cucucuuucAAuuGcAGAudTdT |
| | A | 1933 | 1470 | AUCUGCAAUUGAAAGAGAG | 1628 | AUCUGcAAUUGAAAGAGAGdTdT |
| AD-20080 | S | 1078 | 1471 | ACACCAUCCUCCAGUUGAA | 1629 | AcAccAuccuccAGuuGAAdTdT |
| | A | 1078 | 1472 | UUCAACUGGAGGAUGGUGU | 1630 | UUcAACUGGAGGAUGGUGUdTdT |
| AD-20081 | S | 1545 | 1473 | UAUCCUAGUUCCAUUCUUG | 1631 | uAuccuAGuuccAuucuuGdTdT |
| | A | 1545 | 1474 | CAAGAAUGGAACUAGGAUA | 1632 | cAAGAAUGGAACUAGGAUAdTdT |
| AD-20082 | S | 1109 | 1475 | CAAUCUGGUCUAAUUGUGC | 1633 | cAAucuGGucuAAuuGuGcdTdT |
| | A | 1109 | 1476 | GCACAAUUAGACCAGAUUG | 1634 | GcAcAAUuAGACcAGAUUGdTdT |
| AD-20083 | S | 1398 | 1477 | UCAUGCACUCACAAAGAUA | 1635 | ucAuGcAcucAcAAAGAuAdTdT |
| | A | 1398 | 1478 | UAUCUUUGUGAGUGCAUGA | 1636 | uAUCUUUGUGAGUGcAUGAdTdT |
| AD-20084 | S | 1970 | 1479 | AGACACUACAUUACCCUAA | 1637 | AGAcAcuAcAuuAcccuAAdTdT |
| | A | 1970 | 1480 | UUAGGGUAAUGUAGUGUCU | 1638 | UuAGGGuAAUGuAGUGUCUdTdT |
| AD-20085 | S | 1173 | 1481 | ACACAAGAGGGACUGUAUU | 1639 | AcAcAAGAGGGAcuGuAuudTdT |
| | A | 1173 | 1482 | AAUACAGUCCCUCUUGUGU | 1640 | AAuAcAGUCCCUCUUGUGUdTdT |
| AD-20086 | S | 1313 | 1483 | GAUGCUGAAGUACAGUCCC | 1641 | GAuGcuGAAGuAcAGucccdTdT |
| | A | 1313 | 1484 | GGGACUGUACUUCAGCAUC | 1642 | GGGACUGuACUUcAGcAUCdTdT |
| AD-20087 | S | 1811 | 1485 | AGCCAUAGCUUGAUUGCUC | 1643 | AGccAuAGcuuGAuuGcucdTdT |
| | A | 1811 | 1486 | GAGCAAUCAAGCUAUGGCU | 1644 | GAGcAAUcAAGCuAUGGCUdTdT |
| AD-20088 | S | 1862 | 1487 | CACAGGAGUCCUUUCUUUU | 1645 | cAcAGGAGuccuuucuuuudTdT |
| | A | 1862 | 1488 | AAAAGAAAGGACUCCUGUG | 1646 | AAAAGAAAGGACUCCUGUGdTdT |
| AD-20089 | S | 1600 | 1489 | AUCGUUCGAUUUAAGCCAU | 1647 | AucGuucGAuuuAAGccAudTdT |
| | A | 1600 | 1490 | AUGGCUUAAAUCGAACGAU | 1648 | AUGGCUuAAAUCGAACGAUdTdT |
| AD-20090 | S | 1618 | 1491 | UCAUCAGCUUAAUUUAAGU | 1649 | ucAucAGcuuAAuuuAAGudTdT |
| | A | 1618 | 1492 | ACUUAAAUUAAGCUGAUGA | 1650 | ACUuAAAUuAAGCUGAUGAdTdT |
| AD-20091 | S | 1332 | 1493 | AGCACAUUUCCUCUCUAUC | 1651 | AGcAcAuuuccucucuAucdTdT |
| | A | 1332 | 1494 | GAUAGAGAGGAAAUGUGCU | 1652 | GAuAGAGAGGAAAUGUGCUdTdT |
| AD-20092 | S | 1157 | 1495 | GUGGGCUAUUGAAGAUACA | 1653 | GuGGGcuAuuGAAGAuAcAdTdT |
| | A | 1157 | 1496 | UGUAUCUUCAAUAGCCCAC | 1654 | UGuAUCUUcAAuAGCCcACdTdT |
| AD-20093 | S | 888 | 1497 | AUCAUGUAUUCCCAUCUAG | 1655 | AucAuGuAuucccAucuAGdTdT |
| | A | 888 | 1498 | CUAGAUGGGAAUACAUGAU | 1656 | CuAGAUGGGAAuAcAUGAUdTdT |
| AD-20094 | S | 1855 | 1499 | AAAGACACACAGGAGUCCU | 1657 | AAAGAcAcAcAGGAGuccudTdT |
| | A | 1855 | 1500 | AGGACUCCUGUGUGUCUUU | 1658 | AGGACUCCUGUGUGUCUUUdTdT |
| AD-20095 | S | 1579 | 1501 | CAAAUGAUACAGUCAGGAC | 1659 | cAAAuGAuAcAGucAGGAcdTdT |
| | A | 1579 | 1502 | GUCCUGACUGUAUCAUUUG | 1660 | GUCCUGACUGuAUcAUUUGdTdT |
| AD-20096 | S | 805 | 1503 | UUAGAACAAUUAUCACAUA | 1661 | uuAGAAcAAuuAucAcAuAdTdT |
| | A | 805 | 1504 | UAUGUGAUAAUUGUUCUAA | 1662 | uAUGUGAuAAUUGUUCuAAdTdT |
| AD-20097 | S | 1554 | 1505 | UCCAUUCUUGGUCAAGUUU | 1663 | uccAuucuuGGucAAGuuudTdT |
| | A | 1554 | 1506 | AAACUUGACCAAGAAUGGA | 1664 | AAACUUGACcAAGAAUGGAdTdT |
| AD-20098 | S | 1113 | 1507 | CUGGUCUAAUUGUGCCUCC | 1665 | cuGGucuAAuuGuGccuccdTdT |
| | A | 1113 | 1508 | GGAGGCACAAUUAGACCAG | 1666 | GGAGGcAcAAUuAGACcAGdTdT |
| AD-20099 | S | 1174 | 1509 | CACAAGAGGGACUGUAUUU | 1667 | cAcAAGAGGGAcuGuAuuudTdT |
| | A | 1174 | 1510 | AAAUACAGUCCCUCUUGUG | 1668 | AAAuAcAGUCCCUCUUGUGdTdT |
| AD-20100 | S | 1735 | 1511 | UCUUGUCUCACUUUGGACU | 1669 | ucuuGucucAcuuuGGAcudTdT |
| | A | 1735 | 1512 | AGUCCAAAGUGAGACAAGA | 1670 | AGUCcAAAGUGAGAcAAGAdTdT |
| AD-20101 | S | 1450 | 1513 | UUUUCUAUGGAGCAAAACA | 1671 | uuuucuAuGGAGcAAAAcAdTdT |
| | A | 1450 | 1514 | UGUUUUGCUCCAUAGAAAA | 1672 | UGUUUUGCUCcAuAGAAAAdTdT |
| AD-20102 | S | 804 | 1515 | UUUAGAACAAUUAUCACAU | 1673 | uuuAGAAcAAuuAucAcAudTdT |
| | A | 804 | 1516 | AUGUGAUAAUUGUUCUAAA | 1674 | AUGUGAuAAUUGUUCuAAAdTdT |

TABLE 6-continued

Sequences of dsRNA targeting Human GNAQ (NM_002072.2)
(target is position of 5' base on transcript of NM_002072.2

| Duplex name | Strand | Target | SEQ ID NO: | Unmodified sequence 5' to 3' | SEQ ID NO: | Modified sequence 5' to 3' |
|---|---|---|---|---|---|---|
| AD-20103 | S | 1866 | 1517 | GGAGUCCUUUCUUUUGAAA | 1675 | GGAGuccuuucuuuuGAAAdTdT |
| | A | 1866 | 1518 | UUUCAAAAGAAAGGACUCC | 1676 | UUUcAAAAGAAAGGACUCCdTdT |
| AD-20104 | S | 1610 | 1519 | UUAAGCCAUCAUCAGCUUA | 1677 | uuAAGccAucAucAGcuuAdTdT |
| | A | 1610 | 1520 | UAAGCUGAUGAUGGCUUAA | 1678 | uAAGCUGAUGAUGGCUuAAdTdT |
| AD-20105 | S | 1117 | 1521 | UCUAAUUGUGCCUCCUAGA | 1679 | ucuAAuuGuGccuccuAGAdTdT |
| | A | 1117 | 1522 | UCUAGGAGGCACAAUUAGA | 1680 | UCuAGGAGGcAcAAUuAGAdTdT |
| AD-20106 | S | 1320 | 1523 | AAGUACAGUCCCAGCACAU | 1681 | AAGuAcAGucccAGcAcAudTdT |
| | A | 1320 | 1524 | AUGUGCUGGGACUGUACUU | 1682 | AUGUGCUGGGACUGuACUUdTdT |
| AD-20195 | S | 1317 | 1525 | CUGAAGUACAGUCCCAGCA | 1683 | cuGAAGuAcAGucccAGcAdTdT |
| | A | 1317 | 1526 | UGCUGGGACUGUACUUCAG | 1684 | UGCUGGGACUGuACUUcAGdTdT |

TABLE 7a

Sequences of dsRNA targeting Mouse GNAQ (NM_031036)
(target is position of 5' base on transcript of NM_031036

| Duplex Name | Strand | Target | SEQ ID NO: | Unmodified sequence 5' to 3' | SEQ ID NO: | Modified sequence 5' to 3' |
|---|---|---|---|---|---|---|
| AD-20107 | S | 853 | 1685 | UAUUCCCACCUAGUCGACU | 1719 | uAuucccAccuAGucGAcudTdT |
| | A | 853 | 1686 | AGUCGACUAGGUGGGAAUA | 1720 | AGUCGACuAGGUGGGAAuAdTdT |
| AD-20108 | S | 855 | 1687 | UUCCCACCUAGUCGACUAC | 1721 | uucccAccuAGucGAcuAcdTdT |
| | A | 855 | 1688 | GUAGUCGACUAGGUGGGAA | 1722 | GuAGUCGACuAGGUGGGAAdTdT |
| AD-20109 | S | 367 | 1689 | GCUUUUGAGAAUCCAUAUG | 1723 | GcuuuuGAGAAuccAuAuGdTdT |
| | A | 367 | 1690 | CAUAUGGAUUCUCAAAAGC | 1724 | cAuAUGGAUUCUcAAAAGCdTdT |
| AD-20196 | S | 55 | 1691 | CGGAGGAUCAACGACGAGA | 1725 | cGGAGGAucAAcGAcGAGAdTdT |
| | A | 55 | 1692 | UCUCGUCGUUGAUCCUCCG | 1726 | UCUCGUCGUUGAUCCUCCGdTdT |
| AD-20197 | S | 459 | 1693 | AUCUGACUCUACCAAAUAC | 1727 | AucuGAcucuAccAAAuAcdTdT |
| | A | 459 | 1694 | GUAUUUGGUAGAGUCAGAU | 1728 | GuAUUUGGuAGAGUcAGAUdTdT |
| AD-20110 | S | 312 | 1695 | ACACAAUAAGGCUCAUGCA | 1729 | AcAcAAuAAGGcucAuGcAdTdT |
| | A | 312 | 1696 | UGCAUGAGCCUUAUUGUGU | 1730 | UGcAUGAGCCUuAUUGUGUdTdT |
| AD-20111 | S | 178 | 1697 | AGGAUCAUCCACGGGUCGG | 1731 | AGGAucAuccAcGGGucGGdTdT |
| | A | 178 | 1698 | CCGACCCGUGGAUGAUCCU | 1732 | CCGACCCGUGGAUGAUCCUdTdT |
| AD-20112 | S | 297 | 1699 | CCCAUACAAGUAUGAACAC | 1733 | cccAuAcAAGuAuGAAcAcdTdT |
| | A | 297 | 1700 | GUGUUCAUACUUGUAUGGG | 1734 | GUGUUcAuACUUGuAUGGGdTdT |
| AD-20113 | S | 315 | 1701 | CAAUAAGGCUCAUGCACAA | 1735 | cAAuAAGGcucAuGcAcAAdTdT |
| | A | 315 | 1702 | UUGUGCAUGAGCCUUAUUG | 1736 | UUGUGcAUGAGCCUuAUUGdTdT |
| AD-20114 | S | 58 | 1703 | AGGAUCAACGACGAGAUCG | 1737 | AGGAucAAcGAcGAGAucGdTdT |
| | A | 58 | 1704 | CGAUCUCGUCGUUGAUCCU | 1738 | CGAUCUCGUCGUUGAUCCUdTdT |
| AD-20115 | S | 324 | 1705 | UCAUGCACAAUUGGUUCGA | 1739 | ucAuGcAcAAuuGGuucGAdTdT |
| | A | 324 | 1706 | UCGAACCAAUUGUGCAUGA | 1740 | UCGAACcAAUUGUGcAUGAdTdT |
| AD-20116 | S | 59 | 1707 | GGAUCAACGACGAGAUCGA | 1741 | GGAucAAcGAcGAGAucGAdTdT |
| | A | 59 | 1708 | UCGAUCUCGUCGUUGAUCC | 1742 | UCGAUCUCGUCGUUGAUCCdTdT |
| AD-20117 | S | 398 | 1709 | AGAGCUUGUGGAAUGAUCC | 1743 | AGAGcuuGuGGAAuGAuccdTdT |
| | A | 398 | 1710 | GGAUCAUUCCACAAGCUCU | 1744 | GGAUcAUUCcAcAAGCUCUdTdT |
| AD-20118 | S | 57 | 1711 | GAGGAUCAACGACGAGAUC | 1745 | GAGGAucAAcGAcGAGAucdTdT |
| | A | 57 | 1712 | GAUCUCGUCGUUGAUCCUC | 1746 | GAUCUCGUCGUUGAUCCUCdTdT |

TABLE 7a-continued

Sequences of dsRNA targeting Mouse GNAQ (NM_031036)
(target is position of 5' base on transcript of NM_031036

| Duplex Name | Strand | Target | SEQ ID NO: | Unmodified sequence 5' to 3' | SEQ ID NO: | Modified sequence 5' to 3' |
|---|---|---|---|---|---|---|
| AD-20119 | S | 56 | 1713 | GGAGGAUCAACGACGAGAU | 1747 | GGAGGAucAAcGAcGAGAudTdT |
| | A | 56 | 1714 | AUCUCGUCGUUGAUCCUCC | 1748 | AUCUCGUCGUUGAUCCUCCdTdT |
| AD-20120 | S | 369 | 1715 | UUUUGAGAAUCCAUAUGUA | 1749 | uuuuGAGAAuccAuAuGuAdTdT |
| | A | 369 | 1716 | UACAUAUGGAUUCUCAAAA | 1750 | uAcAuAUGGAUUCUcAAAAdTdT |
| AD-20121 | S | 45 | 1717 | CAAGGAAGCCCGGAGGAUC | 1751 | cAAGGAAGcccGGAGGAucdTdT |
| | A | 45 | 1718 | GAUCCUCCGGGCUUCCUUG | 1752 | GAUCCUCCGGGCUUCCUUGdTdT |

TABLE 7b

Sequences of dsRNA targeting GNAQ (AD-20196 and AD-20197 only)

| Duplex Name | Strand | SEQ ID NO: | Unmodified sequence 5' to 3' | SEQ ID NO: | Modified sequence 5' to 3' |
|---|---|---|---|---|---|
| AD-20196 | S | 1753 | CGGAGGAUCAACGACGAGA | 1757 | cGGAGGAucAAcGAcGAGAdTdT |
| | A | 1754 | UCUCGUCGUUGAUCCUCCG | 1758 | UCUCGUCGUUGAUCCUCCGdTdT |
| AD-20197 | S | 1755 | AUCUGACUCUACCAAAUAC | 1759 | AucuGAcucuAccAAAuAcdTdT |
| | A | 1756 | GUAUUUGGUAGAGUCAGAU | 1760 | GuAUUUGGuAGAGUcAGAUdTdT |

Total RNA isolation using MagMAX-96 Total RNA Isolation Kit (Applied Biosystem, Foster City Calif., Part #: AM1830):

Cells were harvested and lysed in 140 µl of Lysis/Binding Solution then mixed for 1 minute at 850 rpm using and Eppendorf Thermomixer (the mixing speed was the same throughout the process). Twenty micro liters of magnetic beads were added into cell-lysate and mixed for 5 minutes. Magnetic beads were captured using magnetic stand and the supernatant was removed without disturbing the beads. After removing supernatant, magnetic beads were washed with Wash Solution 1 (isopropanol added) and mixed for 1 minute. Beads were capture again and supernatant removed. Beads were then washed with 150 µl Wash Solution 2 (Ethanol added), captured and supernatant was removed. 50 ul of DNase mixture (MagMax turbo DNase Buffer and Turbo DNase) was then added to the beads and they were mixed for 10 to 15 minutes. After mixing, 100 µl of RNA Rebinding Solution was added and mixed for 3 minutes. Supernatant was removed and magnetic beads were washed again with 150 µl Wash Solution 2 and mixed for 1 minute and supernatant was removed completely. The magnetic beads were mixed for 2 minutes to dry before RNA it was eluted with 50 µl of water.

Total RNA Isolation Using RNAqueous®-96 Well Plate Procedure (Applied Biosystem, Foster City Calif., Part #: 1812):

Cells were lysed for 5 minutes in 200 µl of Lysis/Binding Solution. 100 µl of 100% ethanol was added into each cell lysate and the total 300 µl lysates were transferred into one wells of "filter plate". Filter plate was centrifuged at RCF of 10,000-15,000 g for 2 minutes. 300 µl Wash Solution was then added into each well and the plate was centrifuged at RCF of 10,000-15,000g for 2 minutes. For DNase treatment, 20 µl of DNase mixture was added on top of each filter and the plate was incubated for 15 minutes at room temperature. RNA rebinding was performed by washing filters with 200 µL of Rebinding Mix and 1 minute later samples were centrifuged at RCF of 10,000-15,000g for 2 minutes. Filter was washed then twice with 200 µl of Wash Solution and centrifuged at RCF of 10,000-15,000g for 2 minutes. A third centrifugation of 2 minutes was then applied after the reservoir unit was emptied and elution of the RNA was done into a clean culture plate by adding into the filters 50 µL of preheated (80° C.) Nuclease-free Water.

cDNA Synthesis Using ABI High Capacity cDNA Reverse Transcription Kit (Applied Biosystems, Foster City, Calif., Cat #4368813):

A master mix of 2 µl 10× Buffer, 0.8 µl 25×dNTPs, 2 µl Random primers, 1 µl Reverse Transcriptase, 1 µl RNase inhibitor and 3.2 µl of H2O per reaction were added into 10 µl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 µl of cDNA was added to a master mix of 1 µl GAPDH TaqMan Probe (Human GAPD Endogenous Control VIC/MGB Probe, Primer Limited Applied Biosystems Cat #4326317E), 1 µl GNAQ TaqMan probe (Applied Biosystems cat #HS00387073_M1) and 10 µl TaqMan Universal PCR Master Mix (Applied Biosystems Cat #4324018) per well in a MicroAmp Optical 96 well plate (Applied Biosystems cat #4326659). Real time PCR was done in an ABI 7900HT Real Time PCR system (Applied Biosystems) using the ΔΔCt(RQ) assay. All reactions were done in triplicate.

Real time data were analyzed using the ΔΔCt method and normalized to assays performed from cells transfected with 10 nM BlockIT fluorescent Oligo (Invitrogen Cat #2013) or 10 nM AD-1955 a duplex that targets luciferase to calculate fold change.

Results

A total of 94 chemically modified siRNAs were screened. Single dose screens were performed in A549 (lung carcinoma), A375 (malignant melanoma) and uveal melanoma cell lines GNAQ$^{mut}$, OMM1.3, and MEL202. Tables 8-14 show the results of the single-dose in vitro siRNA screen.

TABLE 8

A375 cells (0.1 nM) GNAQ dsRNA single dose in vitro screen
A375 cells (0.1 nM conc.)

| Sample Name | Duplex Name | % Target Remaining | St. Dev error |
|---|---|---|---|
| 26 | AD-20057 | 44.52 | 4.74 |
| 21 | AD-20052 | 49.83 | 4.55 |
| 20 | AD-20051 | 51.94 | 6.86 |
| 38 | AD-20069 | 53.68 | 5.80 |
| 60 | AD-20092 | 54.34 | 5.94 |
| 66 | AD-20099 | 56.06 | 5.86 |
| 14 | AD-20045 | 56.35 | 5.74 |
| 91 | AD-20193 | 57.53 | 3.82 |
| 68 | AD-20101 | 58.44 | 4.72 |
| 23 | AD-20054 | 60.08 | 6.13 |
| 89 | AD-20103 | 60.82 | 5.02 |
| 16 | AD-20047 | 61.66 | 5.59 |
| 53 | AD-20085 | 61.99 | 8.52 |
| 56 | AD-20088 | 62.09 | 7.48 |
| 81 | AD-20116 | 63.84 | 7.76 |
| 19 | AD-20050 | 64.39 | 8.36 |
| 78 | AD-20113 | 64.84 | 7.95 |
| 8 | AD-20039 | 65.29 | 9.23 |
| 51 | AD-20083 | 70.34 | 8.09 |
| 65 | AD-20097 | 71.57 | 5.92 |
| 11 | AD-20042 | 74.74 | 8.67 |
| 43 | AD-20074 | 74.87 | 6.70 |
| 47 | AD-20079 | 75.39 | 6.12 |
| 24 | AD-20055 | 77.24 | 36.15 |
| 58 | AD-20090 | 77.65 | 9.17 |
| 57 | AD-20089 | 78.32 | 9.94 |
| 44 | AD-20076 | 78.59 | 5.98 |
| 46 | AD-20078 | 79.00 | 5.54 |
| 64 | AD-20096 | 80.39 | 5.96 |
| 48 | AD-20080 | 80.66 | 10.31 |
| 84 | AD-20119 | 80.94 | 5.22 |
| 3 | AD-20034 | 81.37 | 7.63 |
| 10 | AD-20041 | 81.65 | 6.39 |
| 12 | AD-20043 | 81.65 | 11.97 |
| 6 | AD-20037 | 81.79 | 11.99 |
| 59 | AD-20091 | 81.79 | 9.24 |
| 13 | AD-20044 | 81.79 | 6.42 |
| 30 | AD-20061 | 85.41 | 8.80 |
| 63 | AD-20095 | 85.71 | 8.69 |
| 18 | AD-20049 | 85.71 | 10.26 |
| 75 | AD-20110 | 86.60 | 13.52 |
| 52 | AD-20084 | 87.81 | 11.94 |
| 69 | AD-20102 | 87.81 | 6.48 |
| 94 | AD-20196 | 88.58 | 6.22 |
| 71 | AD-20106 | 88.73 | 9.38 |
| 70 | AD-20104 | 89.35 | 14.88 |
| 35 | AD-20066 | 89.81 | 7.73 |
| 54 | AD-20086 | 89.97 | 12.64 |
| 45 | AD-20077 | 90.28 | 10.05 |
| 72 | AD-20107 | 90.59 | 5.99 |
| 83 | AD-20118 | 90.75 | 8.80 |
| 34 | AD-20065 | 91.54 | 12.41 |
| 62 | AD-20094 | 92.02 | 10.71 |
| 74 | AD-20109 | 92.82 | 11.79 |
| 79 | AD-20114 | 92.82 | 11.48 |
| 73 | AD-20108 | 93.14 | 8.59 |
| 80 | AD-20115 | 93.47 | 9.77 |
| 93 | AD-20195 | 93.63 | 7.82 |
| 55 | AD-20087 | 93.95 | 15.29 |
| 76 | AD-20111 | 93.95 | 14.29 |
| 92 | AD-20194 | 94.44 | 6.29 |
| 82 | AD-20117 | 94.61 | 12.80 |
| 15 | AD-20046 | 94.61 | 10.42 |
| 22 | AD-20053 | 94.93 | 16.04 |
| 77 | AD-20112 | 95.10 | 12.23 |
| 29 | AD-20060 | 95.10 | 11.08 |
| 67 | AD-20100 | 95.26 | 11.16 |
| 28 | AD-20059 | 95.43 | 11.09 |
| 32 | AD-20063 | 95.93 | 14.32 |
| 25 | AD-20056 | 96.09 | 12.23 |
| 90 |  | 96.26 | 9.50 |
| 95 | AD-20105 | 96.76 | 10.01 |
| 9 | AD-20040 | 97.10 | 7.88 |
| 17 | AD-20048 | 97.10 | 11.44 |
| 88 | AD-20098 | 97.27 | 6.97 |
| 61 | AD-20093 | 97.27 | 12.46 |
| 39 | AD-20070 | 97.43 | 9.70 |
| 7 | AD-20038 | 97.60 | 11.22 |
| 87 |  | 97.94 | 8.37 |
| 49 | AD-20081 | 98.45 | 9.22 |
| 31 | AD-20062 | 98.62 | 13.40 |
| 86 | AD-20121 | 98.62 | 10.71 |
| 50 | AD-20082 | 98.79 | 12.83 |
| 41 | AD-20072 | 98.97 | 9.54 |
| 42 | AD-20073 | 99.48 | 9.92 |
| 85 | AD-20120 | 99.65 | 7.42 |
| 27 | AD-20058 | 99.83 | 16.38 |
| 33 | AD-20064 | 100.35 | 10.82 |
| 1 | AD-20032 | 101.40 | 9.56 |
| 37 | AD-20068 | 101.57 | 9.44 |
| 4 | AD-20035 | 102.99 | 15.49 |
| 2 | AD-20033 | 103.71 | 13.63 |
| 40 | AD-20071 | 104.25 | 10.82 |
| 5 | AD-20036 | 106.25 | 23.63 |

TABLE 9

A375 cells (1.0 nM) single dose GNAQ in vitro screen
A375 cells (1 nM conc.)

| Sample Name | Duplex Name | % Target Remaining | St. Dev error |
|---|---|---|---|
| 26 | AD-20057 | 39.55 | 7.92 |
| 21 | AD-20052 | 41.23 | 9.20 |
| 38 | AD-20069 | 44.42 | 6.19 |
| 68 | AD-20101 | 45.04 | 6.93 |
| 20 | AD-20051 | 45.11 | 8.89 |
| 14 | AD-20045 | 45.98 | 7.80 |
| 19 | AD-20050 | 47.11 | 11.07 |
| 53 | AD-20085 | 47.52 | 9.93 |
| 56 | AD-20088 | 47.60 | 9.91 |
| 16 | AD-20047 | 48.35 | 8.35 |
| 66 | AD-20099 | 48.44 | 8.52 |
| 78 | AD-20113 | 48.69 | 8.81 |
| 81 | AD-20116 | 49.20 | 9.77 |
| 23 | AD-20054 | 49.71 | 8.20 |
| 89 | AD-20103 | 49.80 | 7.27 |
| 91 | AD-20193 | 51.29 | 8.73 |
| 65 | AD-20097 | 52.27 | 9.60 |
| 60 | AD-20092 | 52.46 | 6.04 |
| 51 | AD-20083 | 55.64 | 9.34 |
| 58 | AD-20090 | 57.30 | 9.63 |
| 8 | AD-20039 | 57.70 | 15.80 |
| 11 | AD-20042 | 58.51 | 9.24 |
| 43 | AD-20074 | 59.43 | 9.18 |
| 24 | AD-20055 | 59.53 | 13.24 |
| 47 | AD-20079 | 59.74 | 8.98 |
| 57 | AD-20089 | 59.94 | 11.78 |
| 46 | AD-20078 | 61.10 | 12.31 |
| 18 | AD-20049 | 61.31 | 8.08 |
| 30 | AD-20061 | 63.14 | 11.19 |
| 6 | AD-20037 | 63.91 | 10.65 |
| 10 | AD-20041 | 64.25 | 12.25 |
| 59 | AD-20091 | 64.36 | 10.87 |
| 3 | AD-20034 | 65.26 | 12.38 |
| 13 | AD-20044 | 65.26 | 10.78 |
| 64 | AD-20096 | 66.51 | 10.16 |
| 44 | AD-20076 | 66.86 | 8.87 |
| 93 | AD-20195 | 67.44 | 8.49 |

TABLE 9-continued

A375 cells (1.0 nM) single dose GNAQ in vitro screen
A375 cells (1 nM conc.)

| Sample Name | Duplex Name | % Target Remaining | St. Dev error |
|---|---|---|---|
| 12 | AD-20043 | 68.74 | 12.02 |
| 94 | AD-20196 | 68.98 | 12.81 |
| 35 | AD-20066 | 69.70 | 10.38 |
| 54 | AD-20086 | 70.79 | 13.09 |
| 45 | AD-20077 | 71.04 | 10.55 |
| 84 | AD-20119 | 71.28 | 8.50 |
| 52 | AD-20084 | 71.53 | 14.24 |
| 34 | AD-20065 | 72.15 | 12.77 |
| 29 | AD-20060 | 74.44 | 11.33 |
| 48 | AD-20080 | 74.83 | 9.32 |
| 63 | AD-20095 | 75.09 | 12.36 |
| 75 | AD-20110 | 75.35 | 15.56 |
| 92 | AD-20194 | 76.40 | 12.95 |
| 70 | AD-20104 | 76.67 | 10.72 |
| 28 | AD-20059 | 78.41 | 12.71 |
| 74 | AD-20109 | 78.55 | 15.25 |
| 15 | AD-20046 | 78.69 | 12.82 |
| 55 | AD-20087 | 79.37 | 12.92 |
| 69 | AD-20102 | 80.90 | 11.23 |
| 31 | AD-20062 | 80.90 | 15.87 |
| 4 | AD-20035 | 81.18 | 19.43 |
| 83 | AD-20118 | 82.45 | 19.97 |
| 49 | AD-20081 | 82.60 | 15.95 |
| 67 | AD-20100 | 82.88 | 13.22 |
| 42 | AD-20073 | 83.32 | 14.05 |
| 25 | AD-20056 | 84.19 | 16.11 |
| 62 | AD-20094 | 84.48 | 13.94 |
| 41 | AD-20072 | 84.92 | 12.80 |
| 9 | AD-20040 | 85.21 | 15.48 |
| 71 | AD-20106 | 85.51 | 16.45 |
| 90 |  | 85.81 | 15.45 |
| 7 | AD-20038 | 86.85 | 16.09 |
| 79 | AD-20114 | 87.76 | 16.56 |
| 33 | AD-20064 | 88.07 | 20.64 |
| 80 | AD-20115 | 88.07 | 17.42 |
| 2 | AD-20033 | 88.68 | 16.03 |
| 61 | AD-20093 | 89.76 | 13.56 |
| 32 | AD-20063 | 90.07 | 14.83 |
| 36 | AD-20067 | 90.23 | 9.73 |
| 77 | AD-20112 | 90.54 | 15.45 |
| 86 | AD-20121 | 91.49 | 20.81 |
| 95 | AD-20105 | 91.65 | 17.40 |
| 22 | AD-20053 | 91.97 | 20.15 |
| 5 | AD-20036 | 92.13 | 23.89 |
| 37 | AD-20068 | 92.77 | 14.46 |
| 39 | AD-20070 | 93.09 | 16.90 |
| 27 | AD-20058 | 93.09 | 17.29 |
| 17 | AD-20048 | 93.25 | 14.32 |
| 88 | AD-20098 | 93.25 | 14.60 |
| 82 | AD-20117 | 93.41 | 17.84 |
| 40 | AD-20071 | 94.39 | 15.66 |
| 50 | AD-20082 | 94.88 | 17.58 |
| 87 |  | 95.71 | 15.99 |
| 1 | AD-20032 | 96.71 | 14.37 |
| 73 | AD-20108 | 96.71 | 17.36 |
| 85 | AD-20120 | 97.04 | 11.67 |
| 72 | AD-20107 | 108.05 | 12.36 |

TABLE 10

A549 cells (1.0 nM) single dose GNAQ in vitro screen
A549 cells (1 nM conc.)

| Sample Name | Duplex Name | % Target Remaining | St. Dev error |
|---|---|---|---|
| 78 | AD-20113 | 13.33 | 2.98 |
| 53 | AD-20085 | 15.79 | 3.53 |
| 81 | AD-20116 | 16.44 | 3.68 |
| 21 | AD-20052 | 16.90 | 3.78 |
| 20 | AD-20051 | 17.31 | 3.87 |
| 38 | AD-20069 | 17.71 | 3.96 |
| 66 | AD-20099 | 17.77 | 3.98 |
| 19 | AD-20050 | 18.11 | 4.05 |
| 64 | AD-20096 | 18.17 | 4.07 |
| 26 | AD-20057 | 18.75 | 4.20 |
| 89 | AD-20103 | 19.11 | 4.28 |
| 43 | AD-20074 | 19.28 | 4.31 |
| 51 | AD-20083 | 19.41 | 4.34 |
| 68 | AD-20101 | 19.61 | 4.39 |
| 14 | AD-20045 | 20.06 | 4.49 |
| 8 | AD-20039 | 20.20 | 4.52 |
| 11 | AD-20042 | 20.41 | 4.57 |
| 65 | AD-20097 | 20.99 | 4.70 |
| 60 | AD-20092 | 21.02 | 4.70 |
| 56 | AD-20088 | 22.53 | 5.04 |
| 44 | AD-20076 | 22.57 | 5.05 |
| 58 | AD-20090 | 23.29 | 5.21 |
| 57 | AD-20089 | 23.29 | 5.21 |
| 47 | AD-20079 | 23.69 | 5.30 |
| 74 | AD-20109 | 23.86 | 5.34 |
| 16 | AD-20047 | 24.02 | 5.38 |
| 63 | AD-20095 | 24.36 | 5.45 |
| 59 | AD-20091 | 25.04 | 5.60 |
| 23 | AD-20054 | 25.17 | 5.63 |
| 45 | AD-20077 | 25.61 | 5.73 |
| 48 | AD-20080 | 25.84 | 5.78 |
| 91 | AD-20193 | 28.92 | 6.47 |
| 13 | AD-20044 | 29.83 | 6.68 |
| 6 | AD-20037 | 30.89 | 6.91 |
| 46 | AD-20078 | 31.10 | 6.96 |
| 24 | AD-20055 | 31.64 | 7.08 |
| 85 | AD-20120 | 31.70 | 7.09 |
| 18 | AD-20049 | 33.74 | 7.55 |
| 84 | AD-20119 | 34.75 | 7.77 |
| 3 | AD-20034 | 35.85 | 8.02 |
| 35 | AD-20066 | 36.73 | 8.22 |
| 70 | AD-20104 | 36.92 | 8.26 |
| 12 | AD-20043 | 38.62 | 8.64 |
| 54 | AD-20086 | 38.96 | 8.72 |
| 15 | AD-20046 | 39.98 | 8.95 |
| 34 | AD-20065 | 40.19 | 8.99 |
| 93 | AD-20195 | 41.18 | 9.21 |
| 75 | AD-20110 | 41.18 | 9.21 |
| 69 | AD-20102 | 41.68 | 9.33 |
| 52 | AD-20084 | 42.19 | 9.44 |
| 30 | AD-20061 | 44.29 | 9.91 |
| 94 | AD-20196 | 48.13 | 10.77 |
| 40 | AD-20071 | 48.21 | 10.79 |
| 49 | AD-20081 | 48.72 | 10.90 |
| 10 | AD-20041 | 48.80 | 10.92 |
| 36 | AD-20067 | 48.97 | 10.96 |
| 29 | AD-20060 | 50.79 | 11.36 |
| 31 | AD-20062 | 51.05 | 11.42 |
| 90 |  | 52.12 | 11.66 |
| 55 | AD-20087 | 52.30 | 11.70 |
| 61 | AD-20093 | 52.85 | 11.83 |
| 2 | AD-20033 | 53.50 | 11.97 |
| 25 | AD-20056 | 55.77 | 12.48 |
| 4 | AD-20035 | 56.25 | 12.59 |
| 1 | AD-20032 | 57.43 | 12.85 |
| 92 | AD-20194 | 60.19 | 13.47 |
| 42 | AD-20073 | 61.03 | 13.65 |
| 5 | AD-20036 | 61.45 | 13.75 |
| 28 | AD-20059 | 61.99 | 13.87 |
| 50 | AD-20082 | 62.09 | 13.89 |
| 67 | AD-20100 | 63.29 | 14.16 |
| 83 | AD-20118 | 64.06 | 14.33 |
| 62 | AD-20094 | 64.17 | 14.36 |
| 27 | AD-20058 | 64.95 | 14.53 |
| 7 | AD-20038 | 69.26 | 15.50 |
| 79 | AD-20114 | 71.45 | 15.99 |
| 39 | AD-20070 | 72.07 | 16.13 |
| 41 | AD-20072 | 74.61 | 16.69 |
| 86 | AD-20121 | 74.61 | 16.69 |
| 33 | AD-20064 | 75.39 | 16.87 |
| 9 | AD-20040 | 80.11 | 17.92 |

TABLE 10-continued

A549 cells (1.0 nM) single dose GNAQ in vitro screen
A549 cells (1 nM conc.)

| Sample Name | Duplex Name | % Target Remaining | St. Dev error |
|---|---|---|---|
| 72 | AD-20107 | 82.22 | 18.40 |
| 95 | AD-20105 | 86.90 | 19.45 |
| 73 | AD-20108 | 87.96 | 19.68 |
| 17 | AD-20048 | 89.04 | 19.92 |
| 88 | AD-20098 | 90.13 | 20.17 |
| 77 | AD-20112 | 90.44 | 20.24 |
| 80 | AD-20115 | 91.07 | 20.38 |
| 22 | AD-20053 | 91.86 | 20.55 |
| 37 | AD-20068 | 92.50 | 20.70 |
| 32 | AD-20063 | 92.66 | 20.73 |
| 76 | AD-20111 | 92.82 | 20.77 |
| 71 | AD-20106 | 92.98 | 20.80 |
| 82 | AD-20117 | 109.81 | 24.57 |
| 87 |  | 110.19 | 24.65 |

TABLE 11

OMM1.3 cells (10 nM) single dose GNAQ in vitro screen
OMM1.3 cells (10 nM conc.)

| Sample Name | Duplex Name | % Target Remaining | St. Dev error |
|---|---|---|---|
| 85 | AD-20120 | 51.12 | 7.27 |
| 58 | AD-20090 | 51.83 | 11.83 |
| 89 | AD-20103 | 53.57 | 6.93 |
| 68 | AD-20101 | 54.50 | 10.88 |
| 64 | AD-20096 | 54.60 | 9.30 |
| 57 | AD-20089 | 54.98 | 10.87 |
| 53 | AD-20085 | 55.07 | 11.92 |
| 38 | AD-20069 | 55.55 | 10.05 |
| 59 | AD-20091 | 55.94 | 13.82 |
| 51 | AD-20083 | 56.42 | 13.08 |
| 60 | AD-20092 | 56.72 | 11.64 |
| 65 | AD-20097 | 57.61 | 8.03 |
| 45 | AD-20077 | 57.81 | 11.18 |
| 63 | AD-20095 | 57.81 | 10.19 |
| 43 | AD-20074 | 58.01 | 11.58 |
| 91 | AD-20193 | 58.11 | 10.38 |
| 26 | AD-20057 | 58.21 | 10.36 |
| 20 | AD-20051 | 58.41 | 7.60 |
| 24 | AD-20055 | 58.92 | 9.65 |
| 66 | AD-20099 | 59.74 | 10.83 |
| 44 | AD-20076 | 59.74 | 12.63 |
| 23 | AD-20054 | 59.95 | 8.25 |
| 47 | AD-20079 | 60.06 | 11.09 |
| 56 | AD-20088 | 60.06 | 12.78 |
| 61 | AD-20093 | 60.06 | 13.48 |
| 41 | AD-20072 | 60.37 | 12.49 |
| 13 | AD-20044 | 61.11 | 12.23 |
| 35 | AD-20066 | 61.32 | 11.53 |
| 90 |  | 61.53 | 10.72 |
| 19 | AD-20050 | 61.64 | 10.53 |
| 14 | AD-20045 | 61.85 | 7.21 |
| 15 | AD-20046 | 61.96 | 10.96 |
| 21 | AD-20052 | 62.07 | 7.36 |
| 34 | AD-20065 | 62.61 | 8.87 |
| 29 | AD-20060 | 62.71 | 11.52 |
| 16 | AD-20047 | 62.93 | 8.91 |
| 93 | AD-20195 | 63.26 | 10.94 |
| 69 | AD-20102 | 63.59 | 7.49 |
| 54 | AD-20086 | 64.25 | 16.58 |
| 50 | AD-20082 | 64.59 | 16.58 |
| 94 | AD-20196 | 64.70 | 9.71 |
| 48 | AD-20080 | 64.70 | 12.16 |
| 30 | AD-20061 | 64.81 | 9.02 |
| A2 |  | 65.26 | 13.18 |
| 70 | AD-20104 | 65.83 | 8.26 |
| A3 |  | 66.41 | 11.43 |
| 18 | AD-20049 | 68.27 | 11.57 |
| 49 | AD-20081 | 68.75 | 15.03 |
| 55 | AD-20087 | 69.35 | 14.25 |

TABLE 11-continued

OMM1.3 cells (10 nM) single dose GNAQ in vitro screen
OMM1.3 cells (10 nM conc.)

| Sample Name | Duplex Name | % Target Remaining | St. Dev error |
|---|---|---|---|
| 31 | AD-20062 | 69.71 | 10.58 |
| 52 | AD-20084 | 71.42 | 17.10 |
| A4 |  | 72.29 | 8.52 |
| 67 | AD-20100 | 73.68 | 15.34 |
| 27 | AD-20058 | 74.19 | 12.01 |
| 36 | AD-20067 | 74.32 | 17.93 |
| 33 | AD-20064 | 75.23 | 14.71 |
| 72 | AD-20107 | 75.88 | 10.61 |
| 28 | AD-20059 | 76.94 | 13.68 |
| A1 |  | 76.94 | 14.61 |
| 71 | AD-20106 | 77.08 | 12.79 |
| 25 | AD-20056 | 79.11 | 12.52 |
| 8 | AD-20039 | 80.21 | 10.01 |
| 39 | AD-20070 | 80.49 | 14.56 |
| 88 | AD-20098 | 80.63 | 11.15 |
| 40 | AD-20071 | 80.77 | 16.38 |
| 62 | AD-20094 | 81.75 | 16.23 |
| 86 | AD-20121 | 84.49 | 9.13 |
| 17 | AD-20048 | 84.64 | 16.94 |
| 12 | AD-20043 | 86.87 | 14.40 |
| 22 | AD-20053 | 87.93 | 14.30 |
| 11 | AD-20042 | 88.23 | 13.27 |
| 37 | AD-20068 | 91.66 | 17.18 |
| 32 | AD-20063 | 91.98 | 14.78 |
| 87 |  | 94.56 | 10.00 |
| 9 | AD-20040 | 96.89 | 12.28 |
| 6 | AD-20037 | 97.90 | 16.58 |
| 2 | AD-20033 | 100.48 | 17.62 |
| 3 | AD-20034 | 100.83 | 12.65 |
| 1 | AD-20032 | 105.84 | 19.01 |
| 7 | AD-20038 | 114.62 | 16.88 |
| 5 | AD-20036 | 115.42 | 14.21 |
| 4 | AD-20035 | 123.49 | 11.58 |
| 10 | AD-20041 | 135.05 | 65.85 |

TABLE 12

OMM1.3 cells (10 nM) single dose GNAQ in vitro screen
OMM1.3 (10 nM conc.)

| Sample Name | Duplex Name | % Target Remaining | St. Dev error |
|---|---|---|---|
| 38 | AD-20069 | 50.04 | 6.45 |
| 68 | AD-20101 | 50.30 | 7.35 |
| 53 | AD-20085 | 51.09 | 11.53 |
| 66 | AD-20099 | 51.45 | 8.97 |
| 64 | AD-20096 | 51.72 | 8.35 |
| 43 | AD-20074 | 53.17 | 6.93 |
| 21 | AD-20052 | 53.54 | 8.56 |
| 51 | AD-20083 | 53.54 | 10.85 |
| 58 | AD-20090 | 53.82 | 9.62 |
| 45 | AD-20077 | 54.29 | 8.36 |
| 26 | AD-20057 | 54.76 | 12.81 |
| 56 | AD-20088 | 54.86 | 12.18 |
| 65 | AD-20097 | 54.86 | 7.64 |
| 89 | AD-20103 | 55.24 | 9.10 |
| 63 | AD-20095 | 55.33 | 9.42 |
| 23 | AD-20054 | 55.53 | 7.94 |
| 19 | AD-20050 | 55.53 | 8.95 |
| 57 | AD-20089 | 55.82 | 10.84 |
| 91 | AD-20193 | 56.01 | 10.65 |
| 16 | AD-20047 | 56.20 | 8.85 |
| 20 | AD-20051 | 56.50 | 9.35 |
| 47 | AD-20079 | 56.50 | 7.15 |
| 15 | AD-20046 | 56.69 | 7.92 |
| 44 | AD-20076 | 57.09 | 8.01 |
| 59 | AD-20091 | 57.09 | 9.56 |
| 8 | AD-20039 | 57.29 | 7.18 |
| 61 | AD-20093 | 57.58 | 10.14 |
| 14 | AD-20045 | 57.78 | 10.19 |
| 85 | AD-20120 | 57.78 | 9.98 |

TABLE 12-continued

OMM1.3 cells (10 nM) single dose GNAQ in vitro screen
OMM1.3 (10 nM conc.)

| Sample Name | Duplex Name | % Target Remaining | St. Dev error |
|---|---|---|---|
| 54 | AD-20086 | 57.88 | 9.77 |
| 11 | AD-20042 | 58.90 | 11.84 |
| 13 | AD-20044 | 59.41 | 11.72 |
| 48 | AD-20080 | 60.55 | 9.45 |
| 41 | AD-20072 | 60.87 | 6.66 |
| A2 |  | 61.08 | 9.29 |
| 12 | AD-20043 | 61.72 | 13.93 |
| 35 | AD-20066 | 61.72 | 11.27 |
| 6 | AD-20037 | 61.72 | 9.69 |
| 69 | AD-20102 | 61.93 | 10.90 |
| 34 | AD-20065 | 62.15 | 12.75 |
| 60 | AD-20092 | 62.25 | 10.76 |
| 50 | AD-20082 | 62.80 | 11.11 |
| 3 | AD-20034 | 63.12 | 7.93 |
| 10 | AD-20041 | 63.89 | 9.55 |
| 18 | AD-20049 | 64.00 | 9.43 |
| 30 | AD-20061 | 64.12 | 10.78 |
| 29 | AD-20060 | 64.23 | 12.25 |
| 70 | AD-20104 | 65.35 | 10.65 |
| 52 | AD-20084 | 67.54 | 14.15 |
| 55 | AD-20087 | 67.77 | 12.89 |
| 90 |  | 67.77 | 10.53 |
| 24 | AD-20055 | 68.36 | 10.68 |
| 9 | AD-20040 | 68.60 | 11.16 |
| 5 | AD-20036 | 69.08 | 10.37 |
| 93 | AD-20195 | 69.44 | 10.54 |
| 2 | AD-20033 | 70.04 | 12.33 |
| 31 | AD-20062 | 71.02 | 11.73 |
| 49 | AD-20081 | 71.02 | 11.45 |
| 39 | AD-20070 | 71.51 | 9.18 |
| 27 | AD-20058 | 71.88 | 11.58 |
| 67 | AD-20100 | 72.01 | 9.95 |
| 94 | AD-20196 | 72.26 | 15.50 |
| A1 |  | 72.89 | 8.79 |
| 33 | AD-20064 | 73.39 | 13.32 |
| A4 |  | 73.65 | 12.42 |
| A3 |  | 74.55 | 14.37 |
| 25 | AD-20056 | 74.81 | 12.70 |
| 28 | AD-20059 | 74.94 | 14.91 |
| 40 | AD-20071 | 75.20 | 10.84 |
| 36 | AD-20067 | 76.64 | 12.54 |
| 71 | AD-20106 | 76.64 | 10.67 |
| 4 | AD-20035 | 76.91 | 10.25 |
| 22 | AD-20053 | 78.80 | 15.37 |
| 86 | AD-20121 | 79.48 | 10.26 |
| 7 | AD-20038 | 79.62 | 10.32 |
| 17 | AD-20048 | 80.59 | 13.99 |
| 88 | AD-20098 | 81.01 | 12.34 |
| 72 | AD-20107 | 82.00 | 16.19 |
| 62 | AD-20094 | 82.43 | 14.56 |
| 32 | AD-20063 | 84.60 | 12.39 |
| 37 | AD-20068 | 93.22 | 16.05 |
| 87 |  | 94.52 | 14.29 |
| 1 | AD-20032 | 115.87 | 15.00 |

TABLE 13

UMEL 202 cells (10 nM) single dose GNAQ in vitro screen
UMEL 202 cells (10 nm Conc.)

| Sample Name | Duplex Name | % Target Remaining | St. Dev error |
|---|---|---|---|
| 51 | AD-20083 | 17.87 | 3.17 |
| 85 | AD-20120 | 18.37 | 4.48 |
| 45 | AD-20077 | 18.76 | 5.42 |
| 68 | AD-20101 | 18.82 | 3.16 |
| 26 | AD-20057 | 19.42 | 3.43 |
| 64 | AD-20096 | 19.66 | 3.25 |
| 15 | AD-20046 | 19.83 | 4.71 |
| 58 | AD-20090 | 19.90 | 4.30 |
| 57 | AD-20089 | 20.74 | 4.31 |
| 53 | AD-20085 | 21.55 | 4.68 |
| 89 | AD-20103 | 22.15 | 4.48 |
| 63 | AD-20095 | 22.31 | 2.70 |
| 21 | AD-20052 | 22.46 | 4.02 |
| 11 | AD-20042 | 22.66 | 2.36 |
| 59 | AD-20091 | 22.78 | 4.06 |
| 20 | AD-20051 | 22.86 | 3.46 |
| 38 | AD-20069 | 23.34 | 5.47 |
| 16 | AD-20047 | 23.58 | 3.90 |
| 43 | AD-20074 | 23.62 | 5.71 |
| 19 | AD-20050 | 23.87 | 4.41 |
| 8 | AD-20039 | 23.91 | 2.96 |
| 14 | AD-20045 | 24.33 | 4.08 |
| 47 | AD-20079 | 25.10 | 5.85 |
| 50 | AD-20082 | 25.27 | 4.51 |
| 3 | AD-20034 | 25.49 | 4.73 |
| 61 | AD-20093 | 25.54 | 4.75 |
| 60 | AD-20092 | 25.76 | 4.91 |
| 56 | AD-20088 | 25.94 | 3.59 |
| 66 | AD-20099 | 26.03 | 4.28 |
| 65 | AD-20097 | 26.30 | 4.82 |
| 41 | AD-20072 | 27.09 | 6.80 |
| 13 | AD-20044 | 27.61 | 5.71 |
| 2 | AD-20033 | 27.70 | 3.68 |
| 91 | AD-20193 | 27.90 | 4.64 |
| 29 | AD-20060 | 27.99 | 5.33 |
| 44 | AD-20076 | 28.04 | 7.95 |
| A2 |  | 28.29 | 6.73 |
| 54 | AD-20086 | 28.78 | 5.43 |
| 69 | AD-20102 | 29.18 | 4.79 |
| 48 | AD-20080 | 29.28 | 8.11 |
| 5 | AD-20036 | 30.90 | 4.82 |
| A3 |  | 30.95 | 6.03 |
| 18 | AD-20049 | 31.06 | 4.57 |
| 6 | AD-20037 | 31.17 | 3.46 |
| 30 | AD-20061 | 31.49 | 6.96 |
| 35 | AD-20066 | 31.71 | 39.01 |
| 34 | AD-20065 | 34.05 | 7.29 |
| 90 |  | 34.11 | 5.07 |
| 94 | AD-20196 | 34.17 | 6.48 |
| 23 | AD-20054 | 34.46 | 5.09 |
| 12 | AD-20043 | 34.70 | 2.93 |
| 10 | AD-20041 | 34.76 | 6.00 |
| 55 | AD-20087 | 36.55 | 8.21 |
| 31 | AD-20062 | 36.81 | 7.00 |
| 49 | AD-20081 | 37.06 | 7.58 |
| 25 | AD-20056 | 39.04 | 9.55 |
| 70 | AD-20104 | 39.59 | 6.12 |
| 52 | AD-20084 | 39.93 | 6.61 |
| A4 |  | 40.42 | 7.46 |
| 93 | AD-20195 | 41.99 | 7.10 |
| 40 | AD-20071 | 42.28 | 8.86 |
| 27 | AD-20058 | 43.40 | 9.27 |
| 4 | AD-20035 | 47.00 | 6.36 |
| 24 | AD-20055 | 47.08 | 6.37 |
| A1 |  | 48.65 | 10.76 |
| 9 | AD-20040 | 50.46 | 8.04 |
| 28 | AD-20059 | 50.63 | 12.97 |
| 39 | AD-20070 | 51.43 | 9.23 |
| 36 | AD-20067 | 52.42 | 10.11 |
| 33 | AD-20064 | 52.78 | 10.02 |
| 17 | AD-20048 | 54.36 | 8.74 |
| 88 | AD-20098 | 55.50 | 9.72 |
| 86 | AD-20121 | 57.16 | 8.59 |
| 67 | AD-20100 | 58.87 | 8.34 |
| 22 | AD-20053 | 65.32 | 10.91 |
| 62 | AD-20094 | 68.10 | 10.87 |
| 7 | AD-20038 | 72.48 | 9.86 |
| 37 | AD-20068 | 74.00 | 17.25 |
| 71 | AD-20106 | 82.39 | 11.32 |
| 32 | AD-20063 | 83.11 | 17.34 |
| 72 | AD-20107 | 89.39 | 11.20 |
| 87 |  | 99.18 | 18.11 |
| 1 | AD-20032 | 119.33 | 18.54 |

TABLE 14

MEL 202 cells (10 nM) single dose GNAQ in vitro screen UMEL202 cells (10 nM)

| Sample Name | Duplex Name | % Target Remaining | St. Dev error |
|---|---|---|---|
| 85 | AD-20120 | 16.28 | 1.84 |
| 26 | AD-20057 | 18.41 | 3.50 |
| 68 | AD-20101 | 18.73 | 3.64 |
| 45 | AD-20077 | 19.09 | 4.41 |
| 64 | AD-20096 | 19.33 | 4.19 |
| 21 | AD-20052 | 21.08 | 3.11 |
| 51 | AD-20083 | 21.22 | 4.27 |
| 58 | AD-20090 | 22.36 | 4.62 |
| 63 | AD-20095 | 22.55 | 3.04 |
| 20 | AD-20051 | 23.22 | 2.94 |
| 53 | AD-20085 | 23.43 | 4.97 |
| 57 | AD-20089 | 23.43 | 4.55 |
| 8 | AD-20039 | 24.00 | 3.73 |
| 89 | AD-20103 | 24.25 | 5.69 |
| 15 | AD-20046 | 24.30 | 3.82 |
| 38 | AD-20069 | 25.02 | 5.88 |
| 19 | AD-20050 | 25.11 | 3.28 |
| 11 | AD-20042 | 25.20 | 3.93 |
| 16 | AD-20047 | 25.20 | 3.98 |
| 59 | AD-20091 | 25.41 | 5.04 |
| 43 | AD-20074 | 25.50 | 6.00 |
| 61 | AD-20093 | 25.50 | 4.07 |
| 66 | AD-20099 | 25.68 | 3.88 |
| 65 | AD-20097 | 25.90 | 2.90 |
| 56 | AD-20088 | 25.95 | 4.67 |
| 47 | AD-20079 | 26.31 | 5.00 |
| 41 | AD-20072 | 26.96 | 5.21 |
| 69 | AD-20102 | 27.19 | 3.81 |
| 14 | AD-20045 | 27.72 | 5.20 |
| 13 | AD-20044 | 28.10 | 5.06 |
| 50 | AD-20082 | 28.25 | 5.67 |
| 54 | AD-20086 | 28.35 | 4.75 |
| 60 | AD-20092 | 28.84 | 4.72 |
| 29 | AD-20060 | 29.04 | 5.29 |
| 2 | AD-20033 | 29.24 | 4.55 |
| 91 | AD-20193 | 29.30 | 7.31 |
| 35 | AD-20066 | 29.40 | 6.42 |
| 3 | AD-20034 | 29.45 | 5.51 |
| A2 | | 30.70 | 5.81 |
| 48 | AD-20080 | 30.86 | 7.14 |
| 44 | AD-20076 | 31.07 | 7.63 |
| 12 | AD-20043 | 31.29 | 7.00 |
| 30 | AD-20061 | 31.40 | 5.57 |
| 94 | AD-20196 | 32.22 | 8.75 |
| A3 | | 32.73 | 7.68 |
| 18 | AD-20049 | 33.36 | 6.21 |
| 5 | AD-20036 | 34.12 | 4.63 |
| 34 | AD-20065 | 34.60 | 4.89 |
| 6 | AD-20037 | 34.66 | 5.71 |
| 70 | AD-20104 | 35.32 | 5.17 |
| 23 | AD-20054 | 35.39 | 5.08 |
| 90 | | 36.19 | 8.71 |
| 10 | AD-20041 | 36.82 | 5.22 |
| A4 | | 36.89 | 11.72 |
| 93 | AD-20195 | 37.73 | 9.95 |
| 31 | AD-20062 | 37.93 | 7.86 |
| 25 | AD-20056 | 40.51 | 8.37 |
| 55 | AD-20087 | 40.65 | 10.00 |
| 52 | AD-20084 | 41.72 | 7.24 |
| 24 | AD-20055 | 43.26 | 6.08 |
| 49 | AD-20081 | 43.34 | 13.40 |
| 27 | AD-20058 | 45.57 | 7.25 |
| A1 | | 45.89 | 8.52 |
| 4 | AD-20035 | 46.13 | 8.13 |
| 28 | AD-20059 | 48.25 | 8.52 |
| 36 | AD-20067 | 48.84 | 13.01 |
| 40 | AD-20071 | 48.93 | 9.64 |
| 88 | AD-20098 | 50.30 | 12.25 |
| 33 | AD-20064 | 50.48 | 7.61 |
| 9 | AD-20040 | 50.74 | 6.96 |
| 67 | AD-20100 | 50.92 | 9.41 |
| 39 | AD-20070 | 53.36 | 14.44 |
| 17 | AD-20048 | 53.45 | 6.78 |
| 22 | AD-20053 | 66.61 | 12.90 |
| 86 | AD-20121 | 66.84 | 16.28 |
| 62 | AD-20094 | 67.89 | 11.19 |
| 7 | AD-20038 | 70.53 | 8.81 |
| 71 | AD-20106 | 81.44 | 14.31 |
| 32 | AD-20063 | 83.29 | 12.02 |
| 72 | AD-20107 | 85.04 | 14.05 |
| 87 | | 100.26 | 29.22 |
| 37 | AD-20068 | 108.58 | 54.53 |
| 1 | AD-20032 | 124.62 | 15.51 |

Duplexes with desirable levels of GNAQ inhibition were selected for further analysis of IC50 in A549 (lung carcinoma) MEL202 (GNAQ$_{mut}$ uveal melanoma), and OMM1.3 cells (GNAQ$_{mut}$ liver metastisis). Tables 15-17 show the results of the IC50 experiments in A549, MEL202, and OMM1.3 cells. Dose response screen identified pM IC50s in lung carcinoma cell line and GNAQmut uveal melanoma MEL202 and OMM1.3, including duplexes AD-20057 and AD-20051.

TABLE 15

IC50 in A549 cells

| Rank | Duplex Name | IC50 in [nM] | IC50 in [pM] |
|---|---|---|---|
| 1 | AD-20057 | 0.0002 | 0.2 |
| 2 | AD-20069 | 0.0026 | 2.6 |
| 3 | AD-20051 | 0.0031 | 3.1 |
| 4 | AD-20052 | 0.0032 | 3.2 |
| 5 | AD-20099 | 0.0033 | 3.3 |
| 6 | AD-20045 | 0.0052 | 5.2 |
| 7 | AD-20193 | 0.0064 | 6.4 |
| 8 | AD-20092 | 0.0094 | 9.4 |
| 9 | AD-20116 | 0.0098 | 9.8 |
| 10 | AD-20039 | 0.0137 | 13.7 |
| 11 | AD-20042 | 0.0172 | 17.2 |

TABLE 16

IC50 in MEL 202 cells

| Rank | Duplex Name/(Sample Name) | IC50 in [nM] |
|---|---|---|
| 1 | AD-20057 (26) | 0.001 |
| 2 | AD-20069 (38) | 0.002 |
| 3 | AD-20051 (20) | 0.002 |
| 4 | AD-20052 (21) | 0.003 |
| 5 | AD-20045 (14) | 0.003 |
| 6 | AD-20193 (91) | 0.003 |
| 7 | AD-20092 (60) | 0.003 |
| 8 | AD-20099 (66) | 0.004 |
| 9 | AD-20101 (68) | 0.005 |
| 10 | AD-20116 (81) | 0.006 |
| 11 | AD-20039 (8) | 0.006 |
| 12 | AD-20103 (89) | 0.007 |
| 13 | AD-20085 (53) | 0.008 |
| 14 | AD-20113 (78) | 0.010 |
| 15 | AD-20083 (51) | 0.010 |
| 16 | AD-20096 (64) | 0.010 |
| 17 | AD-20042 (11) | 0.011 |
| 18 | AD-20090 (58) | 0.023 |
| 19 | AD-20119 (84) | 0.024 |
| 20 | AD-20120 (85) | 0.037 |
| 21 | AD-20109 (74) | 0.047 |
| 22 | AD-20077 (45) | 0.084 |

TABLE 17

IC50 in OMM1.3 cells

| Rank | Duplex Name (Sample) | IC50 in [nM] |
|---|---|---|
| 1 | AD-20057 (26) | 0.0043 |
| 2 | AD-20069 (38) | 0.0115 |
| 3 | AD-20052 (21) | 0.0183 |
| 4 | AD-20051 (20) | 0.0197 |
| 5 | AD-20099 (66) | 0.0270 |
| 6 | AD-20092 (60) | 0.0280 |
| 7 | AD-20193 (91) | 0.0335 |
| 8 | AD-20101 (68) | 0.0531 |
| 9 | AD-20045 (14) | 0.0538 |
| 10 | AD-20113 (78) | 0.0625 |
| 11 | AD-20039 (8) | 0.0693 |
| 12 | AD-20103 (89) | 0.0820 |
| 13 | AD-20085 (53) | 0.0842 |
| 14 | AD-20116 (81) | 0.1280 |
| 15 | AD-20083 (51) | 0.1653 |
| 16 | AD-20042 (11) | 0.2470 |
| 17 | AD-20090 (58) | 0.2593 |
| 18 | AD-20096 (64) | 0.3006 |
| 19 | AD-20120 (85) | 0.6189 |
| 20 | AD-20119 (84) | 1.2276 |
| 21 | AD-20109 (74) | 1.2558 |
| 22 | AD-20077 (45) | 2.0044 |

Example 4

In Vitro Dose Response

For in vitro dose response experiments, cells expressing GNAQ were utilized. Some exemplary cell lines expressing GNAQ include, but are not limited to, human melanoma cell lines OMM1.3 and Mel 202 and MEL-285.

The dsRNAs were screened for in vitro inhibition of the target gene at 1 nM, 0.1 nM, 0.01 nM, and 0.001 nM. Tissue culture cells were transfected with the dsRNA. Target gene mRNA levels were assayed using qPCR (real time PCR).

Cell Culture and Transfection

For knockdown, OMM-1.3, MEL-202 and MEL-285 were grown to near confluence at 37° C. in an atmosphere of 5% $CO_2$ in RPMI (Invitrogen) supplemented with 10% FBS, streptomycin, and glutamine (ATCC) before being released from the plate by trypsinization. Reverse transfection was carried out by adding 5 µl of Opti-MEM to 5 µl of siRNA duplexes per well into a 96-well plate along with 10 µl of Opti-MEM plus 0.2 µl of Lipofectamine RNAiMax per well (Invitrogen, Carlsbad Calif. cat #13778-150) and incubated at room temperature for 15 minutes. 80 µl of complete growth media without antibiotic containing $2.0 \times 10^4$ OMM-1.3, MEL-202 or MEL-285 cells were then added. Cells were incubated for 24 hours prior to RNA purification. Experiments were performed at 1, 0.1, 0.01 and 0.001 nM final duplex concentration.

Total RNA Isolation Using MagMAX-96 Total RNA Isolation Kit (Applied Biosystem, Foster City Calif., Part #: AM1830):

Cells were harvested and lysed in 140 µl of Lysis/Binding Solution then mixed for 1 minute at 850 rpm using and Eppendorf Thermomixer (the mixing speed was the same throughout the process). Twenty micro liters of magnetic beads and Lysis/Binding Enhancer mixture were added into cell-lysate and mixed for 5 minutes. Magnetic beads were captured using magnetic stand and the supernatant was removed without disturbing the beads. After removing supernatant, magnetic beads were washed with Wash Solution 1 (isopropanol added) and mixed for 1 minute. Beads were capture again and supernatant removed. Beads were then washed with 150 µl Wash Solution 2 (Ethanol added), captured and supernatant was removed. 50 µl of DNase mixture (MagMax turbo DNase Buffer and Turbo DNase) was then added to the beads and they were mixed for 10 to 15 minutes. After mixing, 100 µl of RNA Rebinding Solution was added and mixed for 3 minutes. Supernatant was removed and magnetic beads were washed again with 150 µl Wash Solution 2 and mixed for 1 minute and supernatant was removed completely. The magnetic beads were mixed for 2 minutes to dry before RNA was eluted with 50 µl of water.

cDNA Synthesis Using ABI High Capacity cDNA Reverse Transcription Kit (Applied Biosystems, Foster City, Calif., Cat #4368813):

A master mix of 2 µl 10× Buffer, 0.8 µl 25×dNTPs, 2 µl Random primers, 1 µl Reverse Transcriptase, 1 µl RNase inhibitor and 3.2 µl of H2O per reaction were added into 10 µl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 µl of cDNA were added to a master mix containing 0.5 µl GAPDH TaqMan Probe (Applied Biosystems Cat #4326317E), 0.5 µl GNAQ TaqMan probe (Applied Biosystems cat #HS00387073_m1) and 5 µl Roche Probes Master Mix (Roche Cat #04887301001) per well in a LightCycler 480 384 well plate (Roche cat #0472974001). Real time PCR was done in a LightCycler 480 Real Time PCR machine (Roche). Each duplex was tested in two independent transfections and each transfections was assayed in duplicate.

Real time data were analyzed using the ΔΔCt method. Each sample was normalized to GAPDH expression and knockdown was assessed relative to cells transfected with the non-targeting duplex AD-1955.

The data are presented in Table 18a. Data are expressed as the fraction of message remaining relative to cells targeted with AD-1955. The calculated $IC_{50}$s are presented in Table 18b.

TABLE 18a

In vitro dose response in 3 cell lines

| Duplex name | 1 nM | 0.1 nM | 0.01 nM | 0.001 nM |
|---|---|---|---|---|
| OMM-1.3 | | | | |
| AD-20039 | 0.38 | 0.46 | 0.74 | 0.73 |
| AD-20045 | 0.42 | 0.52 | 0.60 | 0.79 |
| AD-20051 | 0.34 | 0.46 | 0.63 | 1.18 |
| AD-20052 | 0.36 | 0.37 | 0.53 | 0.61 |
| AD-20057 | 0.32 | 0.36 | 0.43 | 0.59 |
| AD-20063 | 0.63 | 0.69 | 0.99 | 0.74 |
| AD-20069 | 0.37 | 0.35 | 0.43 | 0.69 |
| AD-20092 | 0.42 | 0.51 | 0.71 | 0.75 |
| AD-20099 | 0.35 | 0.46 | 0.52 | 0.63 |
| AD-20101 | 0.39 | 0.57 | 0.60 | 0.69 |
| AD-20111 | 0.64 | 0.68 | 0.65 | 0.70 |
| AD-20113 | 0.37 | 0.51 | 0.71 | 0.92 |
| AD-20116 | 0.56 | 0.58 | 0.66 | 0.75 |
| AD-20193 | 0.45 | 0.50 | 0.64 | 0.75 |
| AD-1955 | 1.12 | 1.17 | 0.83 | 0.92 |
| MEL-202 | | | | |
| AD-20039 | 0.35 | 0.44 | 0.63 | 0.83 |
| AD-20045 | 0.30 | 0.36 | 0.53 | 0.55 |
| AD-20051 | 0.22 | 0.37 | 0.67 | 0.88 |
| AD-20052 | 0.33 | 0.39 | 0.66 | 0.85 |
| AD-20057 | 0.28 | 0.29 | 0.39 | 0.77 |
| AD-20063 | 0.93 | 0.87 | 0.95 | 0.97 |
| AD-20069 | 0.35 | 0.39 | 0.39 | 0.75 |

TABLE 18a-continued

In vitro dose response in 3 cell lines

| Duplex name | 1 nM | 0.1 nM | 0.01 nM | 0.001 nM |
|---|---|---|---|---|
| AD-20092 | 0.37 | 0.49 | 0.93 | 0.98 |
| AD-20099 | 0.28 | 0.33 | 0.61 | 0.96 |
| AD-20101 | 0.38 | 0.46 | 0.83 | 0.92 |
| AD-20111 | 0.67 | 0.81 | 0.91 | 0.98 |
| AD-20113 | 0.31 | 0.48 | 0.82 | 0.99 |
| AD-20116 | 0.33 | 0.34 | 0.72 | 0.92 |
| AD-20193 | 0.32 | 0.44 | 0.65 | 0.87 |
| AD-1955 | 1.11 | 0.85 | 1.11 | 0.95 |
| MEL-285 | | | | |
| AD-20039 | 0.29 | 0.47 | 0.95 | 1.09 |
| AD-20045 | 0.39 | 0.42 | 0.69 | 0.86 |
| AD-20051 | 0.34 | 0.34 | 0.73 | 0.90 |
| AD-20052 | 0.30 | 0.53 | 1.17 | 1.22 |
| AD-20057 | 0.37 | 0.34 | 0.54 | 0.86 |
| AD-20063 | 0.99 | 1.05 | 1.52 | 1.37 |
| AD-20069 | 0.27 | 0.33 | 0.55 | 0.80 |
| AD-20092 | 0.39 | 0.58 | 0.78 | 0.82 |
| AD-20099 | 0.28 | 0.40 | 0.92 | 1.10 |
| AD-20101 | 0.35 | 0.57 | 0.82 | 1.05 |
| AD-20111 | 0.75 | 0.79 | 0.78 | 0.73 |
| AD-20113 | 0.32 | 0.53 | 0.92 | 1.18 |
| AD-20116 | 0.55 | 0.51 | 1.17 | 0.91 |
| AD-20193 | 0.42 | 0.47 | 0.79 | 0.95 |
| AD-1955 | 0.93 | 1.01 | 0.93 | 1.15 |

TABLE 18b $IC_{50}$ (pM) in 3 cell lines

| duplex number | MEL202 | OMM1.3 | A549 |
|---|---|---|---|
| AD-20057 | 0.7 | 4.3 | 0.2 |
| AD-20069 | 1.8 | 11.5 | 2.6 |
| AD-20051 | 2.5 | 19.7 | 3.1 |
| AD-20052 | 2.6 | 18.3 | 3.2 |
| AD-20045 | 2.8 | 53.8 | 5.2 |
| AD-20193 | 3.2 | 33.5 | 6.4 |
| AD-20092 | 3.5 | 28 | 9.4 |
| AD-20099 | 3.6 | 27 | 3.3 |
| AD-20101 | 4.9 | 53.1 | |
| AD-20116 | 5.5 | 128 | 9.8 |
| AD-20113 | 9.5 | 62.5 | |
| AD-20039 | 6.1 | 69.3 | 13.7 |

Example 5

Immunostimulatory Assays: Screening siRNA Sequences for Immunostimulatory Ability Twelve siRNA candidates were tested for induction of cytokines associated with immunostimulation (TNF-alpha and IFN-alpha).

Human PBMC were isolated from whole blood from healthy donors (Research Blood Components, Inc., Boston, Mass.) by a standard Ficoll-Hypaque density gradient centrifugation technique. PBMC ($1 \times 10^5$/well/100 μL) were seeded in 96-well flat bottom plates and cultured in RPMI 1640 GlutaMax-1 medium (Invitrogen) supplemented with 10% heat-inactivated fetal bovine serum (Omega Scientific) and 1% antibiotic/antimycotic (Invitrogen).

GNAC siRNAs was transfected into PBMC using N-[1-(2, 3-Dioleoyloxy)propyl]-N,N,N-trimethylammonium methyl-sulfate (DOTAP; Roche). The DOTAP was first diluted in Opti-MEM Reduced Serum medium (Invitrogen) for 5 minutes before mixing with an equal volume of Opti-MEM containing the siRNA. siRNA/DOTAP complexes were incubated for 10-15 minutes at room temperature and subsequently added to PBMC (50 μL/well) which were then cultured at 37° C. 5% $CO_2$. siRNAs were used at a final concentration of 133 nM. The ratio of RNA to transfection reagent was 16.5 pmoles per μL of DOTAP. Transfections were conducted in quadruplicate in all experiments and were performed within two hours of cell plating. Culture supernatants were collected after 20-24 h and assayed for IFN-α and TNF-α by ELISA.

Cytokines were detected and quantified in culture supernatants with a commercially available ELISA kit for IFN-α (BMS216INST) and TNF-α (BMS223INST) from Bender MedSystems (Vienna, Austria).

Results

Figure 2:
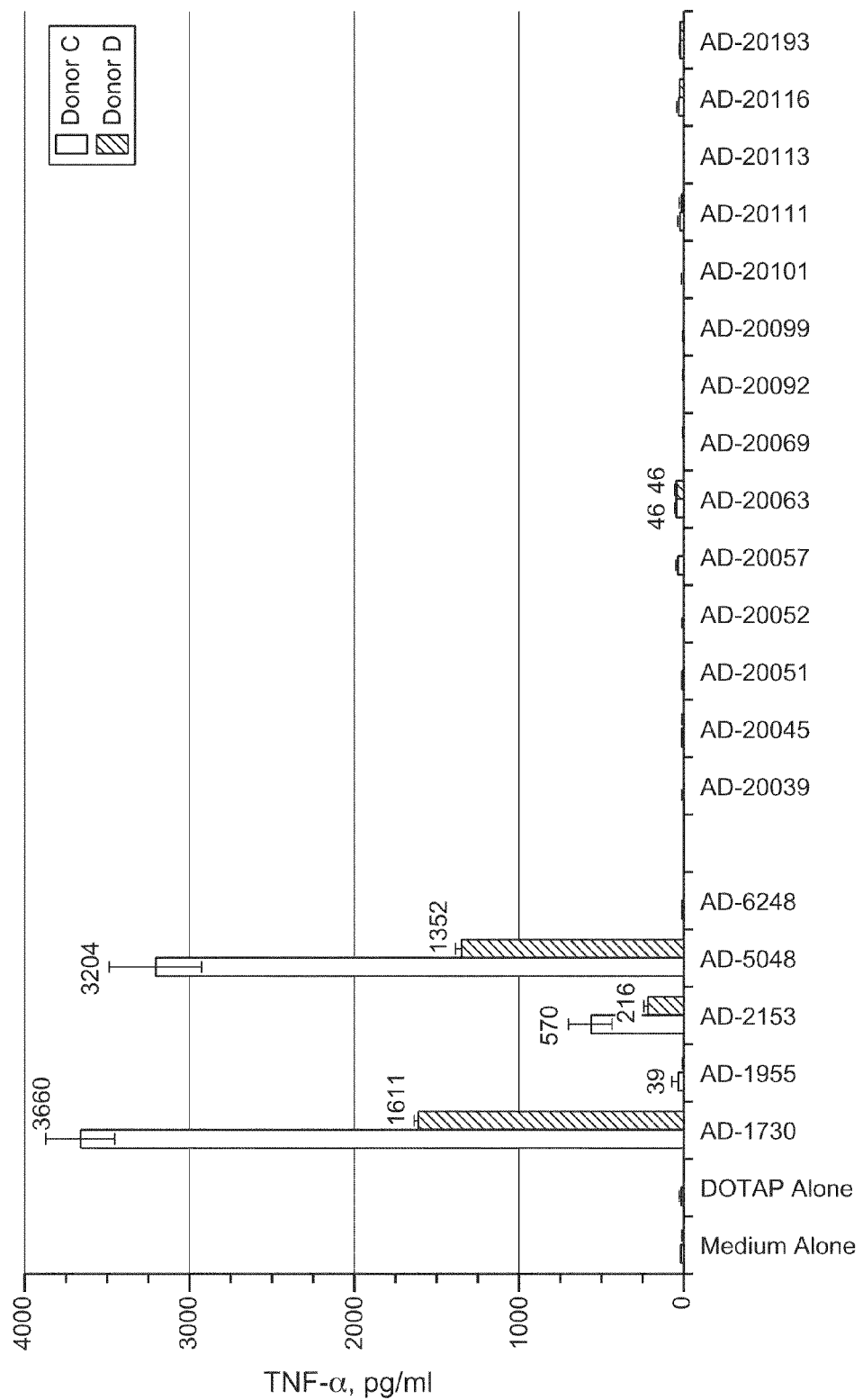
FIG. 2 shows TNF-alpha cytokine induction in human PBMCs following transfection with a set of GNAQ targeted dsRNA.
Figure 3:
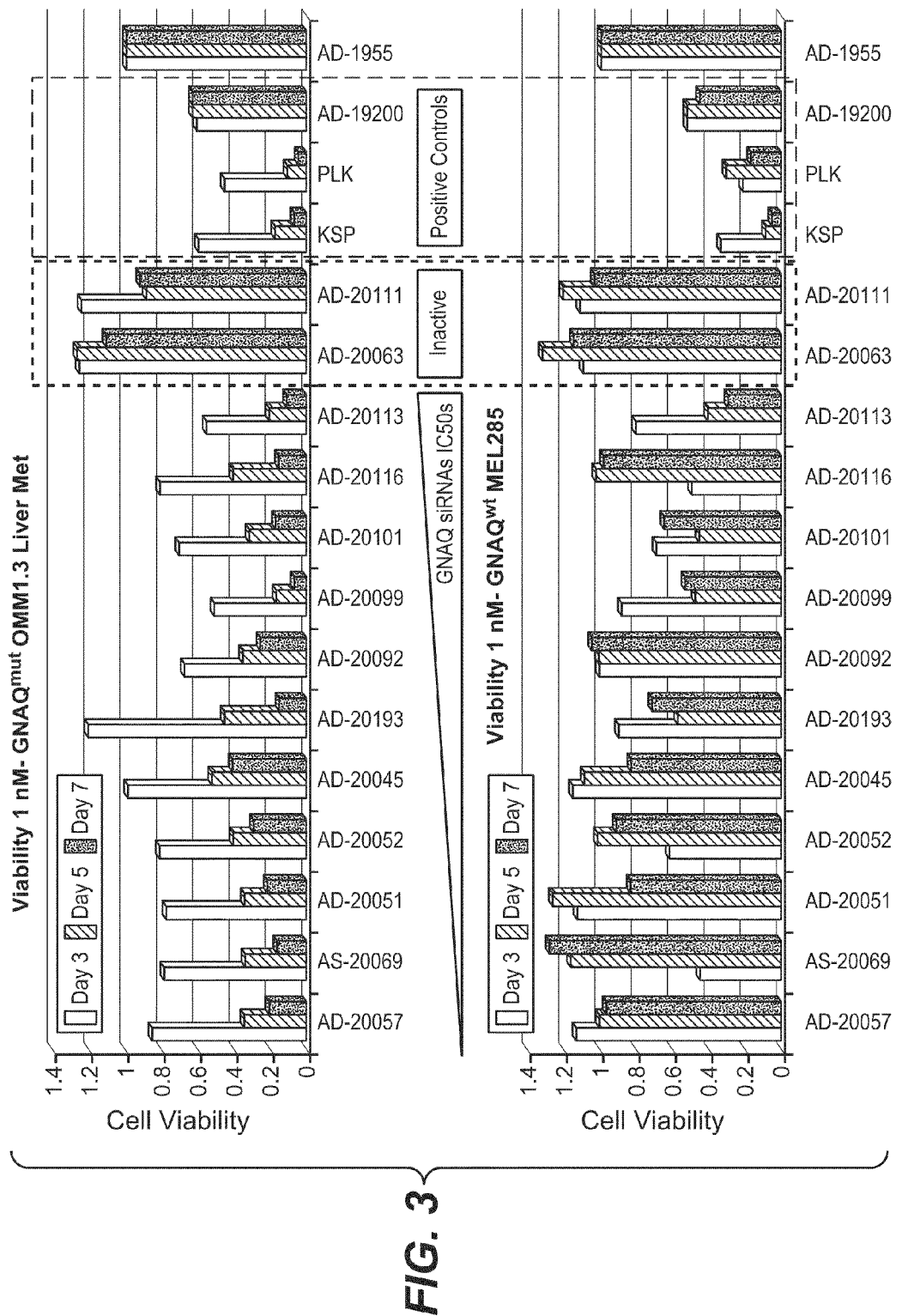
FIG. 3 shows cell viability of OMM1.3 and MEL285 cells following transfection with 1 nM of dsRNAs. The Y-axis is viability normalized to control AD-1955.
Figure 4:
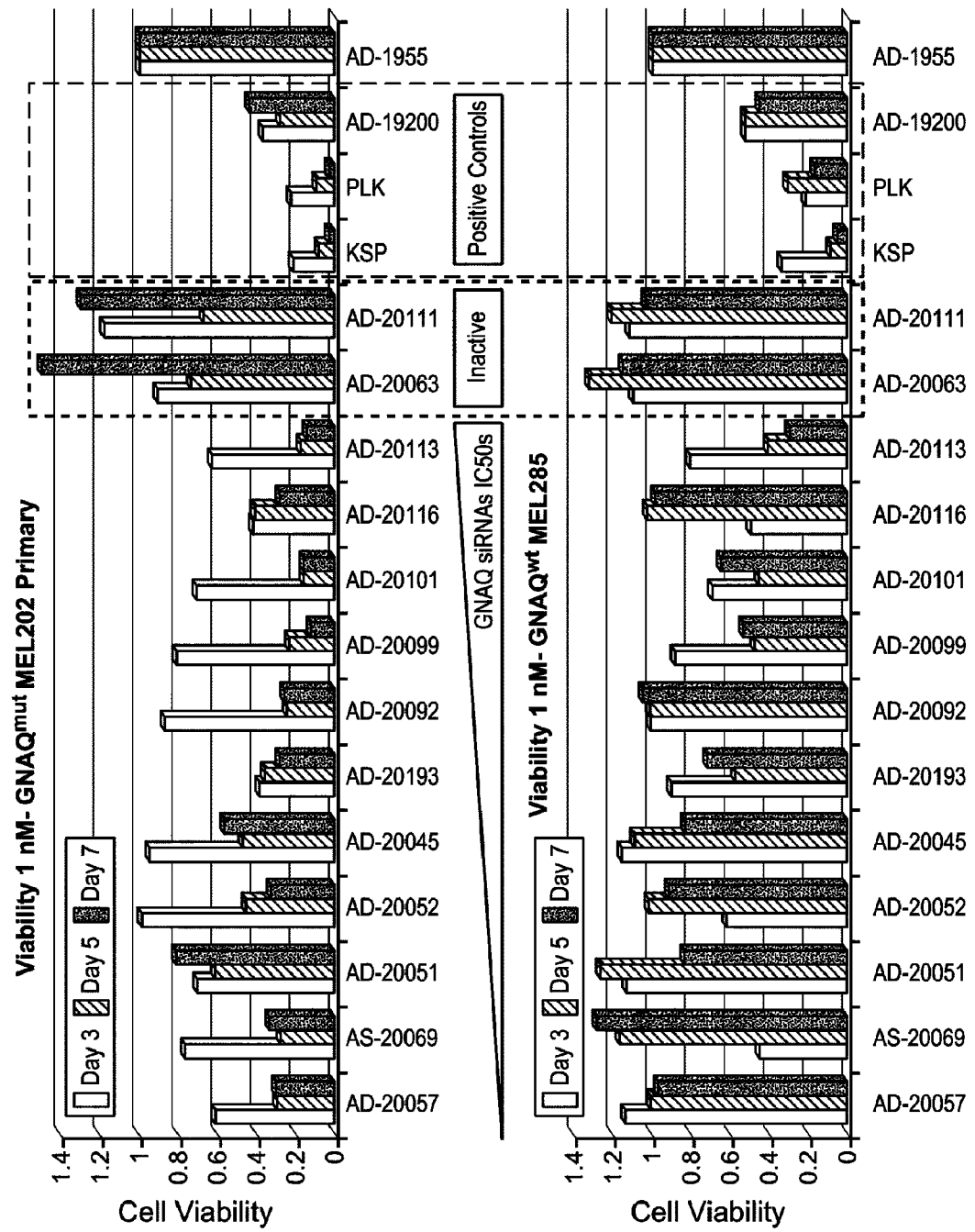
FIG. 4 shows cell viability of MEL202 and MEL285 cells following transfection with 1 nM of dsRNAs. The Y-axis is viability normalized to control AD-1955.
Figure 5:
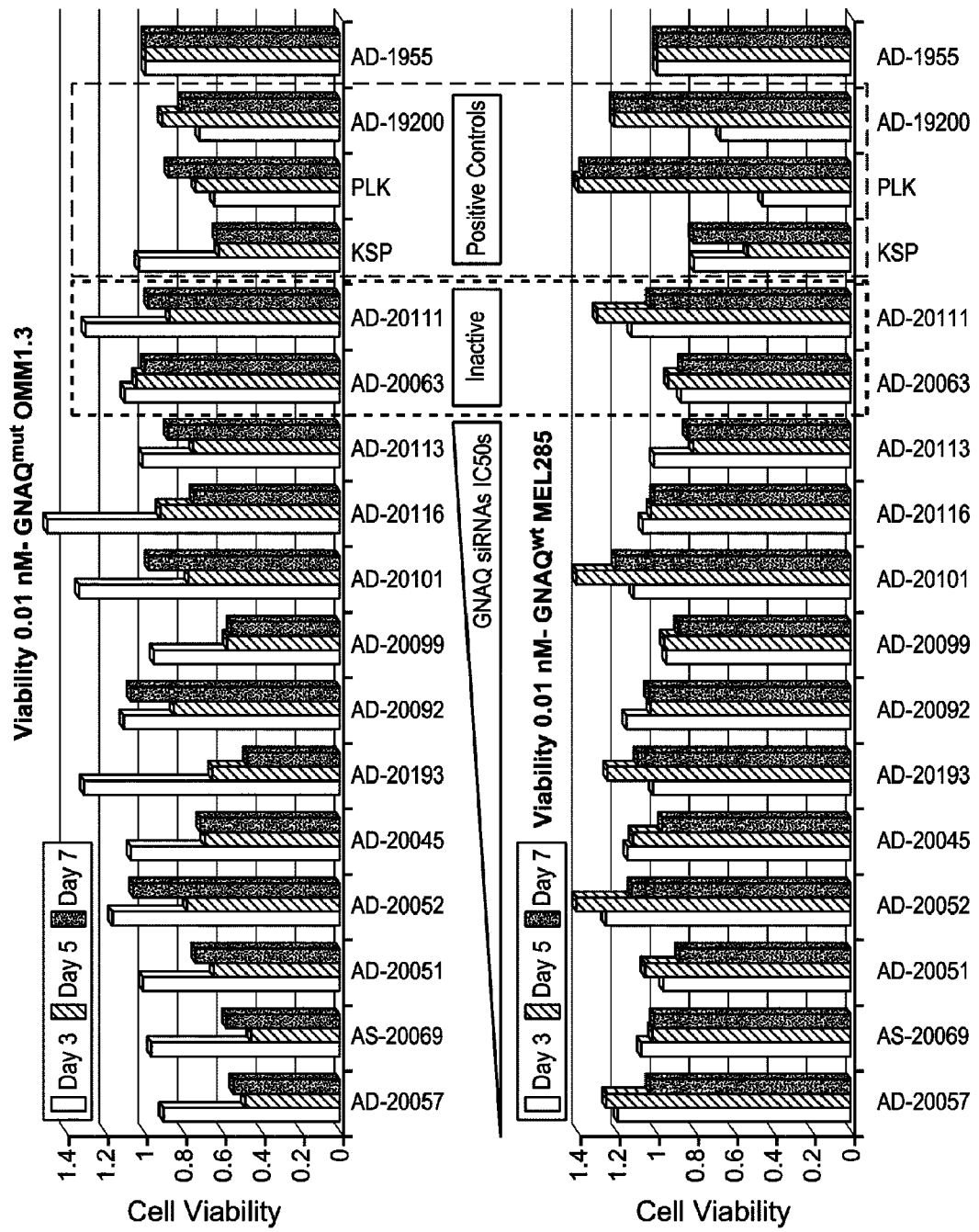
FIG. 5 shows cell viability of OMM1.3 and MEL285 cells following transfection with 0.01 nM of dsRNAs. The Y-axis is viability normalized to control AD-1955.
Figure 6:
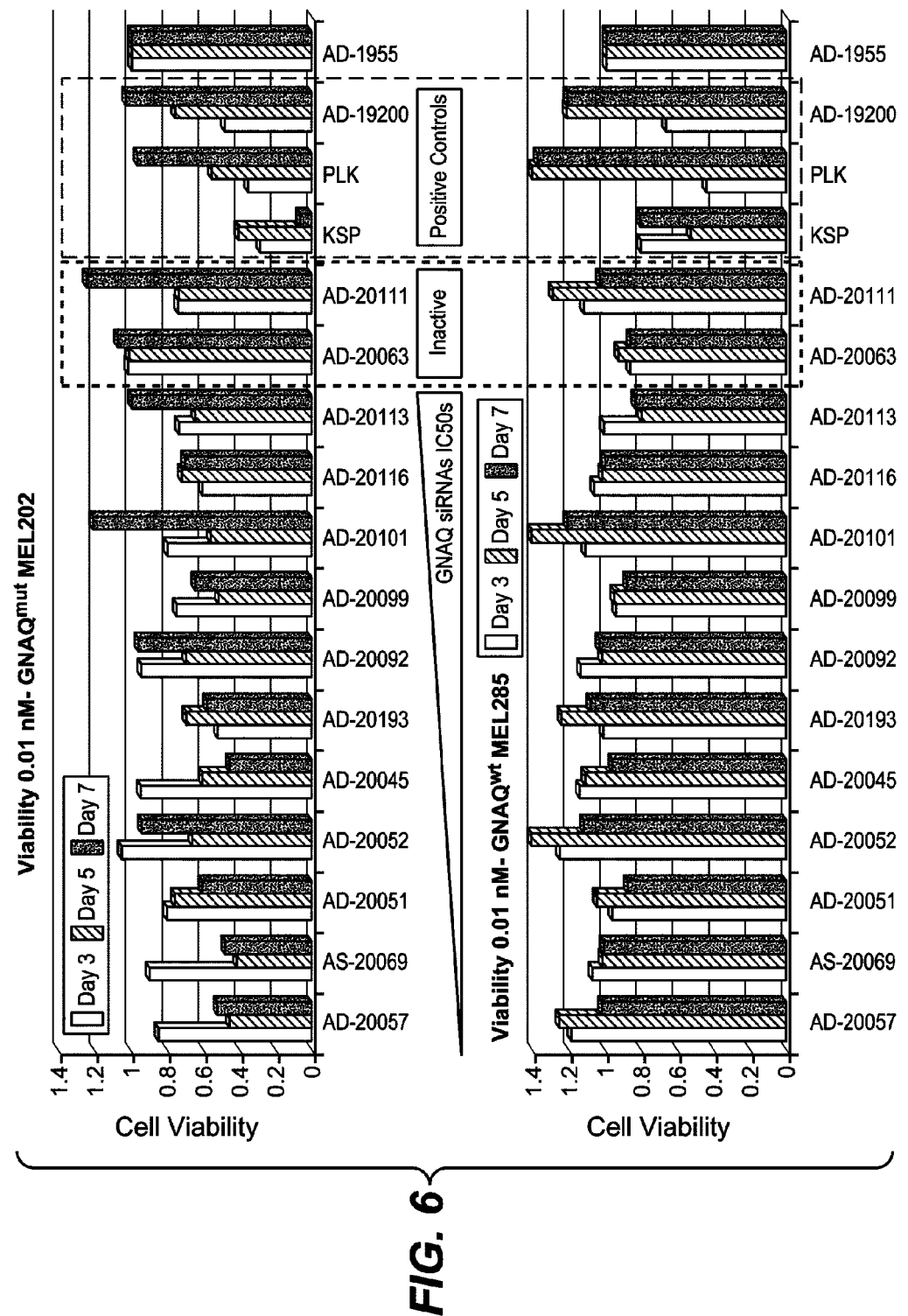
FIG. 6 shows cell viability of MEL202 and MEL285 cells following transfection with 0.01 nM of dsRNAs. The Y-axis is viability normalized to control AD-1955.

The data in Table 19 are presented as a percentage to a AD-5048 stimulated cytokine response. AD-5048 (positive control) corresponds to a sequence that targets human Apolipoprotein B (Soutschek et al., 2004) and elicits both an IFN-α and TNF-α. FIG. 1 and FIG. 2 shows the cytokine induction following transfection with siRNAs.

None of the siRNAs tested demonstrated significant expression of IFN-α and TNF-α in Human PBMCs compared to AD-5048. In particular, AD-20051 and AD-20057 were found to be non immunostimulatory in HuPBMC assay.

TABLE 19

Immunostimulatory activity

| Duplex name | % IFN-α/AD-5048 | % TNF-α/AD-5048 |
|---|---|---|
| AD-20039 | 0 | 0 |
| AD-20045 | 0 | 0 |
| AD-20051 | 0 | 0 |
| AD-20052 | 0 | 0 |
| AD-20057 | 0 | 0 |
| AD-20069 | 0 | 0 |
| AD-20092 | 0 | 0 |
| AD-20099 | 0 | 0 |
| AD-20101 | 0 | 0 |
| AD-20113 | 0 | 0 |
| AD-20116 | 0 | 0 |
| AD-20193 | 0 | 0 |

Example 6

In Vitro Cell Viability

A set of dsRNAs were screened for effects on in vitro cell viability. Tissue culture cells were transfected with the dsRNA and viability was assayed by staining with CellTiter-BLue and microscopic evaluation.

Cell Culture and Transfection

For viability, OMM-1.3, MEL-202 and MEL-285 cells were grown to near confluence at 37° C. in an atmosphere of 5% $CO_2$ in RPMI, (Invitrogen) supplemented with 10% FBS, Penn/streptomycin, and glutamine (ATCC) before being released from the plate by trypsinization. Reverse transfection was carried out by adding 5 μl of Opti-MEM to 5 μl of siRNA duplexes per well into a 96-well plate along with 10 μl of Opti-MEM plus 0.2 μl of Lipofectamine RNAiMax per well (Invitrogen, Carlsbad Calif. cat #13778-150) and incubated at room temperature for 15 minutes. 80 μl of complete growth media without antibiotic containing $1.0 \times 10^3$ OMM-1.3, MEL-202 or MEL-285 cells were then added. Cells were incubated for 3, 5 or 7 days prior to viability assays. Experiments were performed at 1, 0.1, 0.01 and 0.001 nM final duplex concentration. All transfections were done in triplicate. The siRNAs PLK, and AD-19200 were included as positive controls (result in loss of viability) and AD-1955 was included as a negative control and was used for data normalization.

Cell Viability Assay

For viability assays, 20 μl of CellTiterBlue (Promega, Cat #G8080) was added and mixed into each well of the culture plate 3, 5 or 7 days after transfection with an siRNAs at 1, 0.1, 0.01 or 0.001 nM final concentration. The plates, containing transfected, cultured cells, media and CellTiterBlue were incubated for 1.5 hours and then read on a SpectraMax M5 plate reader (Molecular Devices) at 560 nm (excitation) and 590 nm (emission).

To measure viability, three replicate wells were averaged and subtracted from background (wells containing media and CellTiterBlue, but no cells). Viability is expressed as a normalized value in which cells transfected with GNAQ specific siRNAs or other controls are compared to cells transfected with AD-1955, a non-targeting duplex, cultured under the same conditions.

Results

The results are shown in Table 20. Graphical summaries of the results comparing viability at 3, 5, and 7 days in a single cell line after treatment with each of the duplexes at a single concentration are shown in FIG. 3, FIG. 4, FIG. 5, and FIG. 6.

Figure 7:
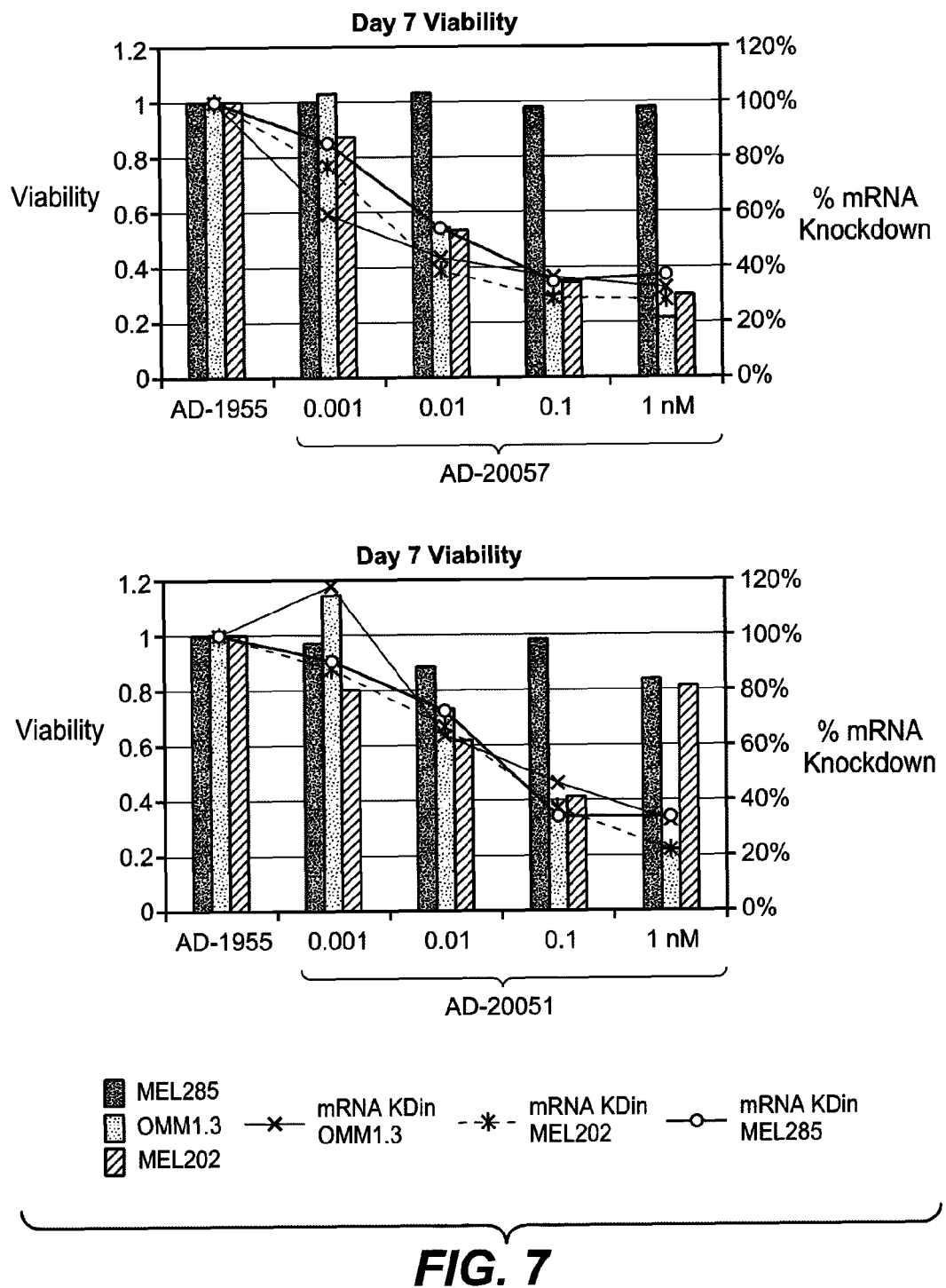
FIG. 7 shows day 7 cell viability of OMM1.3, MEL202, and MEL285 cells following transfection with AD-20057 and AD-20051 dsRNAs
Figure 8:
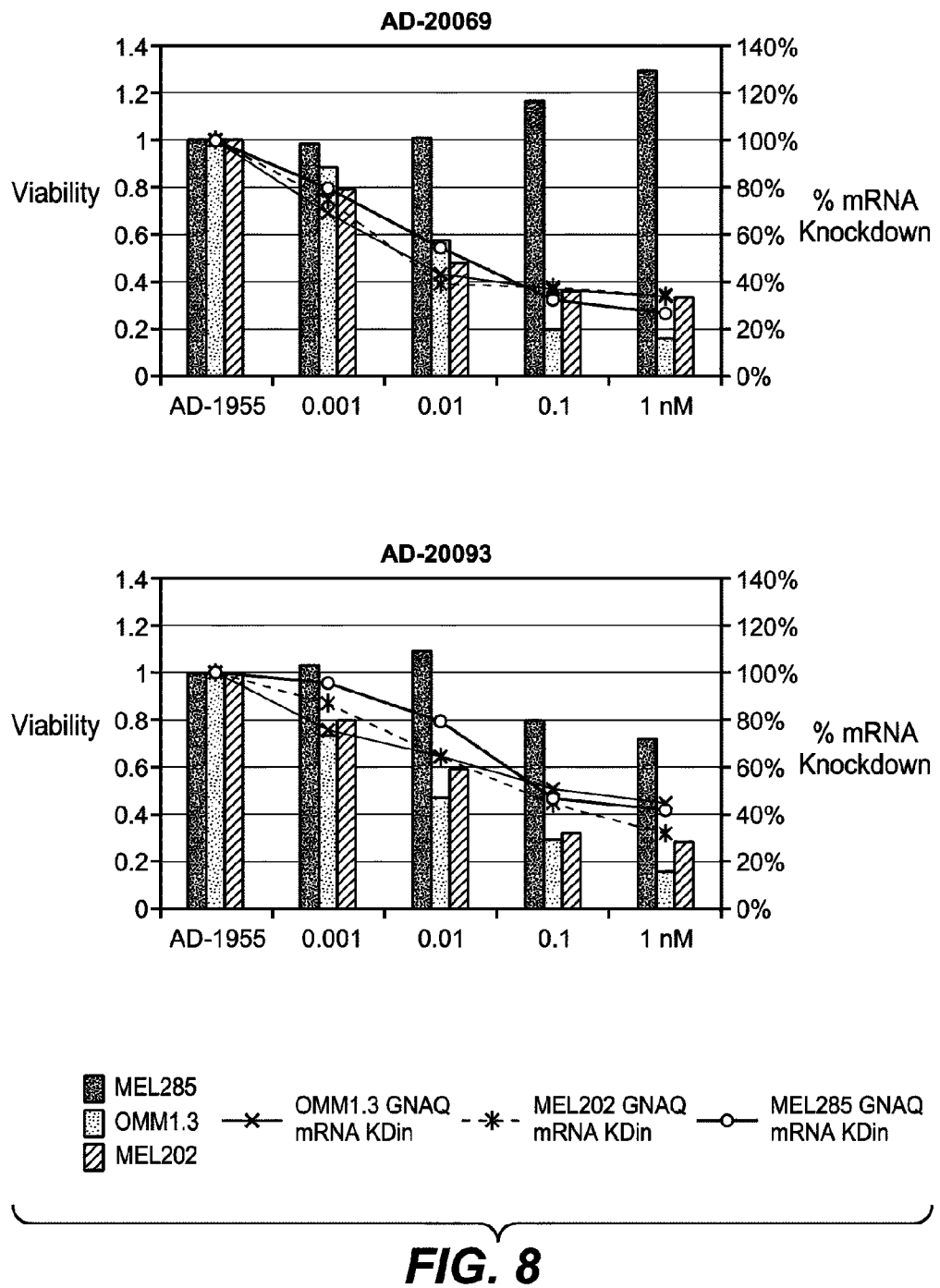
FIG. 8 shows day 7 cell viability of OMM1.3, MEL202, and MEL285 cells following transfection with AD-20069 and AD-20093 dsRNAs.

The results show decreased cell viability in vitro following GNAQ knockdown that was specific for GNAQ mutant cell lines (e.g., OMM1.3, MEL202), but not GNAQ wild-type (e.g., MEL285) cell lines. In particular these results were shown for duplexes AD-20057, AD-20051, AD-20069, and AD-20093 as illustrated by the graphs in FIG. 7 and FIG. 8.

TABLE 20

Cell viability after treatment with siRNA

| | | Day 3 | | | | Day 5 Conc. (in nM) | | | | Day 7 | | | |
|---|---|---|---|---|---|---|---|---|---|---|---|---|---|
| | | 1 nM | 0.1 nM | 0.01 nM | 0.001 nM | 1 nM | 0.1 nM | 0.01 nM | 0.001 nM | 1 nM | 0.1 nM | 0.01 nM | 0.001 nM |
| OMM-1.3 | AD-20039 | 0.95 | 0.96 | 1.18 | 1.27 | 0.46 | 0.48 | 0.79 | 0.94 | 0.25 | 0.52 | 1.18 | 1.32 |
| | AD-20045 | 0.99 | 0.94 | 1.07 | 1.20 | 0.53 | 0.53 | 0.70 | 1.03 | 0.42 | 0.44 | 0.71 | 1.16 |
| | AD-20051 | 0.78 | 0.90 | 1.01 | 0.63 | 0.35 | 0.42 | 0.65 | 0.94 | 0.23 | 0.35 | 0.74 | 1.15 |
| | AD-20052 | 0.82 | 0.90 | 1.17 | 1.38 | 0.41 | 0.47 | 0.79 | 1.02 | 0.31 | 0.45 | 1.06 | 1.24 |
| | AD-20057 | 0.86 | 0.88 | 0.90 | 1.31 | 0.36 | 0.39 | 0.49 | 0.83 | 0.22 | 0.31 | 0.55 | 1.03 |
| | AD-20063 | 1.26 | 1.26 | 1.10 | 0.53 | 1.27 | 1.06 | 1.04 | 0.93 | 1.11 | 0.95 | 1.00 | 1.06 |
| | AD-20069 | 0.79 | 0.72 | 0.96 | 1.16 | 0.35 | 0.39 | 0.46 | 0.86 | 0.17 | 0.21 | 0.58 | 0.89 |
| | AD-20092 | 0.68 | 0.93 | 1.11 | 1.15 | 0.36 | 0.58 | 0.85 | 0.91 | 0.27 | 0.63 | 1.08 | 0.96 |
| | AD-20099 | 0.51 | 0.72 | 0.95 | 1.07 | 0.18 | 0.37 | 0.58 | 0.88 | 0.08 | 0.22 | 0.56 | 0.86 |
| | AD-20101 | 0.72 | 0.76 | 1.34 | 1.53 | 0.33 | 0.40 | 0.78 | 1.00 | 0.18 | 0.39 | 0.98 | 0.95 |
| | AD-20111 | 1.25 | 1.15 | 1.30 | 1.32 | 0.89 | 1.10 | 0.87 | 1.00 | 0.93 | 0.95 | 0.98 | 0.95 |
| | AD-20113 | 0.56 | 0.73 | 1.02 | 1.03 | 0.22 | 0.44 | 0.75 | 0.80 | 0.12 | 0.35 | 0.88 | 0.82 |
| | AD-20116 | 0.82 | 1.23 | 1.64 | 1.88 | 0.41 | 0.70 | 0.92 | 0.98 | 0.17 | 0.51 | 0.75 | 0.73 |
| | AD-20193 | 1.22 | 0.84 | 1.31 | 1.67 | 0.46 | 0.53 | 0.66 | 0.80 | 0.16 | 0.30 | 0.48 | 0.74 |
| | AD-12115 | 0.60 | 0.65 | 1.03 | 1.00 | 0.19 | 0.26 | 0.62 | 0.93 | 0.08 | 0.26 | 0.63 | 0.61 |
| | PLK | 0.47 | 0.80 | 0.65 | 1.67 | 0.12 | 0.54 | 0.74 | 1.00 | 0.06 | 0.64 | 0.88 | 0.78 |
| | AD-19200 | 0.62 | 0.85 | 0.72 | 1.55 | 0.64 | 0.78 | 0.92 | 0.81 | 0.64 | 0.83 | 0.81 | 0.87 |
| | AD-1955 | 1.00 | 1.00 | 1.00 | 1.00 | 1.00 | 1.00 | 1.00 | 1.00 | 1.00 | 1.00 | 1.00 | 1.00 |
| MEL-202 | AD-20039 | 1.21 | 0.98 | 1.02 | 0.93 | 0.72 | 0.56 | 0.79 | 1.00 | 0.78 | 0.66 | 0.75 | 0.88 |
| | AD-20045 | 0.95 | 0.90 | 0.95 | 0.85 | 0.47 | 0.38 | 0.61 | 0.92 | 0.57 | 0.36 | 0.47 | 0.80 |
| | AD-20051 | 0.70 | 0.78 | 0.80 | 0.38 | 0.62 | 0.36 | 0.77 | 0.82 | 0.82 | 0.42 | 0.62 | 0.80 |
| | AD-20052 | 0.98 | 1.02 | 1.06 | 0.93 | 0.46 | 0.42 | 0.67 | 1.02 | 0.33 | 0.55 | 0.95 | 1.03 |
| | AD-20057 | 0.61 | 0.91 | 0.86 | 0.85 | 0.30 | 0.27 | 0.47 | 0.86 | 0.31 | 0.34 | 0.53 | 0.88 |
| | AD-20063 | 0.91 | 1.00 | 1.02 | 0.37 | 0.74 | 0.81 | 1.01 | 0.91 | 1.54 | 1.32 | 1.08 | 1.04 |
| | AD-20069 | 0.77 | 1.03 | 0.91 | 1.00 | 0.28 | 0.44 | 0.43 | 0.64 | 0.34 | 0.37 | 0.49 | 0.79 |
| | AD-20092 | 0.87 | 0.88 | 0.95 | 0.87 | 0.25 | 0.44 | 0.70 | 0.80 | 0.26 | 0.73 | 0.97 | 1.11 |
| | AD-20099 | 0.80 | 0.69 | 0.75 | 0.41 | 0.24 | 0.36 | 0.53 | 0.68 | 0.13 | 0.26 | 0.66 | 1.16 |
| | AD-20101 | 0.72 | 0.92 | 0.80 | 0.87 | 0.16 | 0.48 | 0.57 | 0.73 | 0.17 | 0.51 | 1.21 | 0.92 |
| | AD-20111 | 1.18 | 0.90 | 0.75 | 0.84 | 0.67 | 0.83 | 0.74 | 0.80 | 1.30 | 1.37 | 1.25 | 1.03 |
| | AD-20113 | 0.63 | 0.55 | 0.74 | 0.36 | 0.18 | 0.31 | 0.66 | 0.68 | 0.15 | 0.37 | 1.00 | 1.05 |
| | AD-20116 | 0.42 | 0.59 | 0.62 | 0.93 | 0.41 | 0.51 | 0.73 | 0.90 | 0.29 | 0.38 | 0.71 | 0.77 |
| | AD-20193 | 0.39 | 0.53 | 0.53 | 0.94 | 0.36 | 0.49 | 0.70 | 0.76 | 0.29 | 0.32 | 0.59 | 0.80 |
| | AD-12115 | 0.22 | 0.22 | 0.30 | 0.50 | 0.09 | 0.12 | 0.42 | 0.78 | 0.03 | 0.04 | 0.08 | 0.68 |
| | PLK | 0.23 | 0.27 | 0.37 | 0.63 | 0.10 | 0.16 | 0.56 | 0.65 | 0.03 | 0.07 | 0.97 | 1.19 |
| | AD-19200 | 0.37 | 0.52 | 0.49 | 0.56 | 0.29 | 0.75 | 0.76 | 0.74 | 0.44 | 1.15 | 1.04 | 0.85 |
| | AD-1955 | 1 | 1 | 1 | 1 | 1 | 1 | 1 | 1 | 1 | 1 | 1 | 1 |
| MEL-285 | AD-20039 | 0.58 | 1.37 | 1.23 | 1.23 | 1.07 | 1.25 | 1.13 | 1.09 | 0.82 | 1.06 | 0.96 | 0.93 |
| | AD-20045 | 1.16 | 1.31 | 1.15 | 1.05 | 1.10 | 1.10 | 1.12 | 1.24 | 0.84 | 0.85 | 0.97 | 0.90 |
| | AD-20051 | 1.14 | 1.20 | 0.97 | 0.98 | 1.27 | 1.16 | 1.06 | 1.03 | 0.84 | 0.99 | 0.89 | 0.97 |
| | AD-20052 | 0.63 | 1.40 | 1.26 | 1.04 | 1.03 | 1.40 | 1.42 | 1.21 | 0.92 | 1.02 | 1.13 | 0.98 |
| | AD-20057 | 1.14 | 1.17 | 1.20 | 1.04 | 1.00 | 1.04 | 1.26 | 1.35 | 0.98 | 0.98 | 1.03 | 1.00 |
| | AD-20063 | 1.10 | 1.14 | 0.88 | 0.89 | 1.33 | 1.14 | 0.94 | 0.95 | 1.16 | 1.05 | 0.87 | 0.91 |
| | AD-20069 | 0.46 | 1.09 | 1.08 | 0.96 | 1.17 | 1.20 | 1.03 | 1.04 | 1.29 | 1.17 | 1.01 | 0.99 |
| | AD-20092 | 1.02 | 1.14 | 1.15 | 0.96 | 1.02 | 1.11 | 1.03 | 1.05 | 1.06 | 1.11 | 1.04 | 1.02 |
| | AD-20099 | 0.89 | 1.10 | 0.95 | 0.95 | 0.48 | 0.92 | 0.96 | 1.00 | 0.54 | 0.91 | 0.89 | 1.05 |
| | AD-20101 | 0.70 | 1.16 | 1.12 | 1.04 | 0.47 | 1.12 | 1.41 | 1.42 | 0.66 | 1.01 | 1.22 | 1.03 |
| | AD-20111 | 1.12 | 1.05 | 1.13 | 1.01 | 1.21 | 1.49 | 1.30 | 1.29 | 1.04 | 1.18 | 1.04 | 1.03 |
| | AD-20113 | 0.81 | 0.97 | 1.02 | 1.03 | 0.41 | 0.85 | 0.81 | 0.97 | 0.31 | 0.76 | 0.85 | 1.01 |
| | AD-20116 | 0.50 | 0.86 | 1.07 | 1.01 | 1.03 | 0.98 | 1.03 | 1.01 | 0.99 | 0.91 | 1.01 | 0.94 |
| | AD-20193 | 0.91 | 0.88 | 1.03 | 0.94 | 0.58 | 0.86 | 1.25 | 1.24 | 0.72 | 0.80 | 1.09 | 1.03 |
| | AD-12115 | 0.34 | 0.35 | 0.81 | 0.43 | 0.10 | 0.12 | 0.54 | 1.02 | 0.07 | 0.12 | 0.82 | 1.00 |

TABLE 20-continued

Cell viability after treatment with siRNA

| | Day 3 | | | | Day 5 Conc. (in nM) | | | | Day 7 | | | |
|---|---|---|---|---|---|---|---|---|---|---|---|---|
| | 1 nM | 0.1 nM | 0.01 nM | 0.001 nM | 1 nM | 0.1 nM | 0.01 nM | 0.001 nM | 1 nM | 0.1 nM | 0.01 nM | 0.001 nM |
| PLK | 0.23 | 0.65 | 0.46 | 0.97 | 0.31 | 0.54 | 1.40 | 1.31 | 0.18 | 0.72 | 1.38 | 1.17 |
| AD-19200 | 0.53 | 0.81 | 0.68 | 0.94 | 0.53 | 0.77 | 1.22 | 1.32 | 0.46 | 0.97 | 1.22 | 1.15 |
| AD-1955 | 1.00 | 1.00 | 1.00 | 1.00 | 1.00 | 1.00 | 1.00 | 1.00 | 1.00 | 1.00 | 1.00 | 1.00 |

Example 7

In Vivo Efficacy Studies

The dsRNAs are screened for in vivo inhibition of the target gene in mice. Mice are injected with varying amounts of the dsRNA. Target gene protein levels are assayed using, e.g., mouse plasma and an ELISA with a target gene specific antibody. Target gene mRNA levels are assayed using, e.g., mouse liver and branched DNA assays. The lead candidates are dsRNA that reduce levels of the target gene protein and/or mRNA in a dose-dependent manner.

Regimen for Treatment of Mice with dsRNA

A single-dose IV bolus efficacy study is designed for each dsRNA to be tested: dose level, dosing days, formulation, and number of animals. Mice are intravenously (i.v.) administered target gene specific dsRNA, control dsRNA) or PBS systemically and/or subcutaneously in a range of concentrations, e.g., 1.0 mg/kg, 3.0 mg/kg, or 6.0 mg/kg.

Mice are observed for forty-hours then anesthetized with 200 μl of ketamine, and are exsanguinated by severing the right caudal artery. Whole blood is isolated and placed into EDTA plasma separator tubes and centrifuged at 3000 rpm for 10 minutes. Plasma is isolated and stored at 80° C. until assaying. Liver tissue is collected, flash-frozen and stored at −80° C. until processing.

Efficacy of treatment is evaluated by methods including (i) measurement of protein in plasma at prebleed and at 48 hours post-dose, (ii) measurement of mRNA in liver at 48 hours post-dose, and (iii) efficacy in modulation of target gene specific phenotype, e.g., anti-tumor activity.

Assay of Target Gene Protein in Mouse Plasma

Target plasma levels are assayed by ELISA utilizing the commercially available anti GNAQ antibodies, for example G alpha q (K-17) or G alpha q (E-17) (Santa Cruz Biotechnology Inc. Santa Cruz, Calif., USA, cat #SC-26791 and cat #SC-393), according to manufacturer's guidelines.

Assay of Target Gene mRNA Levels in Mouse Liver

Target gene mRNA levels are assayed utilizing the Branched DNA assays Quantigene 2.0 (Panomics cat #: QS0011). Briefly, mouse liver samples are ground and tissue lysates are prepared. Liver lysis Mixture (a mixture of 1 volume of lysis mixture, 2 volume of nuclease-free water and 10 μl of Proteinase-K/ml for a final concentration of 20 mg/ml.) is incubated at 65° C. for 35 minutes. 20 μl of Working Probe Set (target probe for detection of target gene and GAPDH probe for endogenous control) and 80 ul of tissue-lysate are then added into the Capture Plate. Capture Plates are incubated at 55° C.±1° C. (aprx. 16-20 hrs). The next day, the Capture Plate are washed 3 times with 1× Wash Buffer (nuclease-free water, Buffer Component 1 and Wash Buffer Component 2), then dried by centrifuging for 1 minute at 240 g. 100 ul of pre-Amplifer Working Reagent is added into the Capture Plate, which is sealed with aluminum foil and incubated for 1 hour at 55° C.±1° C. Following 1 hour incubation, the wash step is repeated, then 100 μl of Amplifier Working Reagent is added. After 1 hour, the wash and dry steps are repeated, and 100 μl of Label Probe is added. Capture plates are incubated 50° C.±1° C. for 1 hour. The plate is then washed with 1× Wash Buffer, dried and 100 μl Substrate is added into the Capture Plate. Capture Plates are read using the SpectraMax Luminometer following a 5 to 15 minute incubation. bDNA data are analyzed by subtracting the average background from each triplicate sample, averaging the triplicate GAPDH (control probe) and target gene probe (experimental probe) then taking the ratio: (experimental probe-background)/(control probe-background).

GNAQ Materials and Methods

The GNAQ specific dsRNA are formulated in lipid particles (SNALP) as describe herein and administered systemically or subcutaneously to mice with GNAQ-mutant human uveal melanoma cell tumors implanted in the liver to assess in vivo target knockdown and antitumor activity. The dsRNA duplexes with positive results are selected for further studies to develop a Phase I/II trial in patients with GNAQ-mutant uveal melanoma metastatic to liver.

Example 8

Inhibition of GNAQ in Humans

A human subject is treated with a dsRNA targeted to a GNAQ gene to inhibit expression of the GNAQ gene to treat a condition.

A subject in need of treatment is selected or identified. The subject can have uveal melanoma, cutaneous melanoma, Blue nevi, Nevi of Ota, a neuroendocrine tumor, or a small lung tumor.

The identification of the subject can occur in a clinical setting, or elsewhere, e.g., in the subject's home through the subject's own use of a self-testing kit.

At time zero, a suitable first dose of an anti-GNAQ siRNA is administered to the subject. The dsRNA is formulated as described herein. After a period of time following the first dose, e.g., 7 days, 14 days, and 21 days, the subject's condition is evaluated, e.g., by measuring tumor growth. This measurement can be accompanied by a measurement of GNAQ expression in said subject, and/or the products of the successful siRNA-targeting of GNAQ mRNA. Other relevant criteria can also be measured. The number and strength of doses are adjusted according to the subject's needs.

After treatment, the subject's tumor growth rate is lowered relative to the rate existing prior to the treatment, or relative to the rate measured in a similarly afflicted but untreated subject.

Example 9

GNAQ mRNA Sequences (SEQ ID NO: 1761)

Human GNAQ mRNA NM_002072.2

```
   1 aggggtgcc ggcggggctg cagcggaggc actttggaag aatgactctg gagtccatca
  61 tggcgtgctg cctgagcgag gaggccaagg aagcccggcg gatcaacgac gagatcgagc
 121 ggcagctccg cagggacaag cgggacgccc gcgggagct caagctgctg ctgctcggga
 181 caggagagag tggcaagagt acgtttatca agcagatgag aatcatccat gggtcaggat
 241 actctgatga agataaaagg ggcttcacca agctggtgta tcagaacatc ttcacggcca
 301 tgcaggccat gatcagagcc atggacacac tcaagatccc atacaagtat gagcacaata
 361 aggctcatgc acaattagtt cgagaagttg atgtggagaa ggtgtctgct tttgagaatc
 421 catatgtaga tgcaataaag agtttatgga atgatcctgg aatccaggaa tgctatgata
 481 gacgacgaga atatcaatta tctgactcta ccaaatacta tcttaatgac ttggaccgcg
 541 tagctgaccc tgcctacctg cctacgcaac aagatgtgct tagagttcga gtccccacca
 601 cagggatcat cgaatacccc tttgacttac aaagtgtcat tttcagaatg gtcgatgtag
 661 ggggccaaag gtcagagaga agaaaatgga tacactgctt tgaaaatgtc acctctatca
 721 tgtttctagt agcgcttagt gaatatgatc aagttctcgt ggagtcagac aatgagaacc
 781 gaatggagga agcaaggct ctctttagaa caattatcac ataccctgg ttccagaact
 841 cctcggttat tctgttctta aacaagaaag atcttctaga ggagaaaatc atgtattccc
 901 atctagtcga ctacttccca gaatatgatg accccagag agatgcccag gcagccgag
 961 aattcattct gaagatgttc gtggacctga acccagacag tgacaaaatt atctactccc
1021 acttcacgtg cgccacagac accgagaata tccgctttgt ctttgctgcc gtcaaggaca
1081 ccatcctcca gttgaacctg aaggagtaca atctggtcta attgtgcctc ctagacaccc
1141 gccctgccct tccctggtgg gctattgaag atacacaaga gggactgtat ttctgtggaa
1201 aacaatttgc ataatactaa tttattgccg tcctggactc tgtgtgagcg tgtccacaga
1261 gtttgtagta aatattatga ttttatttaa actattcaga ggaaaaacag aggatgctga
1321 agtacagtcc cagcacattt cctctctatc tttttttag gcaaaacctt gtgactcagt
1381 gtattttaaa ttctcagtca tgcactcaca aagataagac ttgtttcttt ctgtctctct
1441 ctcttttttct tttctatgga gcaaaacaaa gctgatttcc ctttttttcttc ccccgctaa
1501 ttcatacctc cctcctgatg ttttcccag gttacaatgg cctttatcct agttccattc
1561 ttggtcaagt ttttctctca aatgatacag tcaggacaca tcgttcgatt taagccatca
1621 tcagcttaat ttaagtttgt agttttttgct gaaggattat atgtattaat acttacggtt
1681 ttaaatgtgt tgctttggat acacacatag tttcttttt aatagaatat actgtcttgt
1741 ctcactttgg actgggacag tggatgccca tctaaaagtt aagtgtcatt tcttttagat
1801 gtttaccttc agccatagct tgattgctca gagaaatatg cagaaggcag atcaaagac
1861 acacaggagt cctttctttt gaaatgccac gtgccattgt ctttcctccc ttctttgctt
1921 ctttttctta ccctctcttt caattgcaga tgccaaaaaa gatgccaaca gacactacat
1981 taccctaatg gctgctaccc agaaccttt tataggttgt tcttaatttt tttgttgttg
2041 ttgttcaagc ttttccttc tttttttct tagtgtttgg ccacgatttt taaaatgact
2101 tttattatgg gtatgtgttg ccaaagctgg cttttttgtca aataaaatga atacgaactt
2161 aaaaaataaa aaaaaaaaaa aaaaaaa
```

-continued (SEQ ID NO: 1762)
Rat GNAQ mRNA NM_031036

```
   1 atgactctgg agtccatcat ggcgtgctgc ctgagcgagg aggccaagga agcccggagg 61 atcaacgacg agatcgagcg gcagctgcgc agggacaagc gcgacgcccg ccggagctc 121 aagctgctgc tgctggggac aggggagagt ggcaagagta ccttcattaa gcagatgagg 181 atcatccacg ggtcggggta ctctgatgaa gacaagaggg gctttaccaa actggtgtat 241 cagaacatct ttacagccat gcaggccatg gtcagagcta tggacactct caagatccca 301 tacaagtatg aacacaataa ggctcatgca caattggttc gagaggttga tgtggagaag 361 gtgtctgctt ttgagaatcc atatgtagac gcaataaaga gcttgtggaa tgatcctgga 421 atccaggaat gctacgatag acggcgagaa tatcagctat ctgactctac caaatactat 481 ctgaacgact tggaccgtgt ggctgaccct tcctatctgc ctacacaaca agatgtgctt 541 agagttcgag tccccaccac agggatcatt gagtacccct tcgacttaca gagtgtcatc 601 ttcagaatgg tcgatgtagg aggccaaagg tcagagagaa gaaaatggat acactgcttt 661 gaaaacgtca cctcgatcat gtttctggta gcgcttagcg aatacgatca agttcttgtg 721 gagtcagaca atgagaaccg aatggaggag agcaaagcac tctttagaac cattatcaca 781 tatccctggt tccagaactc ctctgttatt ctgttcttaa acaagaaaga tcttctagag 841 gagaaaatta tgtattccca cctagtcgac tacttcccag aatatgatgg accccagaga 901 gatgcccagg cagcacgaga attcatcctg aagatgttcg tggacctgaa ccccgacagt 961 gacaaaatca tctactcgca cttcacgtgt gccacagaca cggagaacat ccgcttcgtg 1021 tttgctgctg tcaaggacac catcctgcag ctgaacctga aggagtacaa tctggtctaa
```

SEQUENCE LISTING (1762 sequences)

SEQ ID NO: 1 - RNA, 19 nt, Artificial Sequence
  Description of Artificial Sequence: Synthetic oligonucleotide
cuaauuuauugccguccug

SEQ ID NO: 2 - RNA, 19 nt, Artificial Sequence
  Description of Artificial Sequence: Synthetic oligonucleotide
aauacuaauuuauugccgu

SEQ ID NO: 3 - RNA, 19 nt, Artificial Sequence
  Description of Artificial Sequence: Synthetic oligonucleotide
cagccauagcuugauugcu

SEQ ID NO: 4 - RNA, 19 nt, Artificial Sequence
  Description of Artificial Sequence: Synthetic oligonucleotide
gucaggacacaucguucga

SEQ ID NO: 5 - RNA, 19 nt, Artificial Sequence
  Description of Artificial Sequence: Synthetic oligonucleotide
cuucccuggugggcuauug

SEQ ID NO: 6 - RNA, 19 nt, Artificial Sequence
  Description of Artificial Sequence: Synthetic oligonucleotide
gacacuacauuacccuaau

SEQ ID NO: 7 - RNA, 19 nt, Artificial Sequence
  Description of Artificial Sequence: Synthetic oligonucleotide
acucugugugagcgugucc

SEQ ID NO: 8 - RNA, 19 nt, Artificial Sequence
  Description of Artificial Sequence: Synthetic oligonucleotide
cccuggugggcuauugaag

SEQ ID NO: 9 - RNA, 19 nt, Artificial Sequence
  Description of Artificial Sequence: Synthetic oligonucleotide
acuaauuuauugccguccu

SEQ ID NO: 10 - RNA, 19 nt, Artificial Sequence
  Description of Artificial Sequence: Synthetic oligonucleotide
cucucaaaugauacaguca

SEQ ID NO: 11 - RNA, 19 nt, Artificial Sequence
  Description of Artificial Sequence: Synthetic oligonucleotide
aguacaaucuggucuaauu

SEQ ID NO: 12 - RNA, 19 nt, Artificial Sequence
  Description of Artificial Sequence: Synthetic oligonucleotide
cacaaagauaagacuuguu

SEQ ID NO: 13 - RNA, 19 nt, Artificial Sequence
  Description of Artificial Sequence: Synthetic oligonucleotide
acaaucuggucuaauugug

SEQ ID NO: 14 - RNA, 19 nt, Artificial Sequence
  Description of Artificial Sequence: Synthetic oligonucleotide
cagucaugcacucacaaag

SEQ ID NO: 15 - RNA, 19 nt, Artificial Sequence
  Description of Artificial Sequence: Synthetic oligonucleotide
gacacaucguucgauuuaa

SEQ ID NO: 16 - RNA, 19 nt, Artificial Sequence
  Description of Artificial Sequence: Synthetic oligonucleotide
cugcuacccagaaccuuuu

SEQ ID NO: 17 - RNA, 19 nt, Artificial Sequence
  Description of Artificial Sequence: Synthetic oligonucleotide
ucagccauagcuugauugc

SEQ ID NO: 18 - RNA, 19 nt, Artificial Sequence
  Description of Artificial Sequence: Synthetic oligonucleotide
auuuauugccguccuggac

SEQ ID NO: 19 - RNA, 19 nt, Artificial Sequence
  Description of Artificial Sequence: Synthetic oligonucleotide
caauuugcauaauacuaau

SEQ ID NO: 20 - RNA, 19 nt, Artificial Sequence
  Description of Artificial Sequence: Synthetic oligonucleotide
guacagucccagcacauuu

SEQ ID NO: 21 - RNA, 19 nt, Artificial Sequence
  Description of Artificial Sequence: Synthetic oligonucleotide
uaccuucagccauagcuug

SEQ ID NO: 22 - RNA, 19 nt, Artificial Sequence
  Description of Artificial Sequence: Synthetic oligonucleotide
acagacacuacauuacccu

SEQ ID NO: 23 - RNA, 19 nt, Artificial Sequence
  Description of Artificial Sequence: Synthetic oligonucleotide
auacuaauuuauugccguc

SEQ ID NO: 24 - RNA, 19 nt, Artificial Sequence
  Description of Artificial Sequence: Synthetic oligonucleotide
gggcuauugaagauacaca

SEQ ID NO: 25 - RNA, 19 nt, Artificial Sequence
  Description of Artificial Sequence: Synthetic oligonucleotide
guucgauuuaagccaucau

SEQ ID NO: 26 - RNA, 19 nt, Artificial Sequence
  Description of Artificial Sequence: Synthetic oligonucleotide
ugugccuccuagacacccg

SEQ ID NO: 27 - RNA, 19 nt, Artificial Sequence
  Description of Artificial Sequence: Synthetic oligonucleotide
cuggacucugugugagcgu

SEQ ID NO: 28 - RNA, 19 nt, Artificial Sequence
  Description of Artificial Sequence: Synthetic oligonucleotide
acccucucuuucaauugca

SEQ ID NO: 29 - RNA, 19 nt, Artificial Sequence
  Description of Artificial Sequence: Synthetic oligonucleotide
cagacacuacauuacccua

SEQ ID NO: 30 - RNA, 19 nt, Artificial Sequence
  Description of Artificial Sequence: Synthetic oligonucleotide
aauuuauugccguccugga

SEQ ID NO: 31 - RNA, 19 nt, Artificial Sequence
  Description of Artificial Sequence: Synthetic oligonucleotide
ugugugagcguguccacag

SEQ ID NO: 32 - RNA, 19 nt, Artificial Sequence
  Description of Artificial Sequence: Synthetic oligonucleotide
ccuggugggcuauugaaga

SEQ ID NO: 33 - RNA, 19 nt, Artificial Sequence
  Description of Artificial Sequence: Synthetic oligonucleotide
accuucagccauagcuuga

SEQ ID NO: 34 - RNA, 19 nt, Artificial Sequence
  Description of Artificial Sequence: Synthetic oligonucleotide
ggaugcugaaguacagucc

SEQ ID NO: 35 - RNA, 19 nt, Artificial Sequence
  Description of Artificial Sequence: Synthetic oligonucleotide
auccuaguuccauucuugg

SEQ ID NO: 36 - RNA, 19 nt, Artificial Sequence
  Description of Artificial Sequence: Synthetic oligonucleotide
uccuaguuccauucuuggu

SEQ ID NO: 37 - RNA, 19 nt, Artificial Sequence
  Description of Artificial Sequence: Synthetic oligonucleotide
ggaguacaaucuggucuaa

SEQ ID NO: 38 - RNA, 19 nt, Artificial Sequence
  Description of Artificial Sequence: Synthetic oligonucleotide
cacauuuccucucuaucuu

SEQ ID NO: 39 - RNA, 19 nt, Artificial Sequence
  Description of Artificial Sequence: Synthetic oligonucleotide
cacagaguuuguaguaaau

SEQ ID NO: 40 - RNA, 19 nt, Artificial Sequence
  Description of Artificial Sequence: Synthetic oligonucleotide
aacagacacuacauuaccc

SEQ ID NO: 41 - RNA, 19 nt, Artificial Sequence
  Description of Artificial Sequence: Synthetic oligonucleotide
uucucagucaugcacucac

SEQ ID NO: 42 - RNA, 19 nt, Artificial Sequence
  Description of Artificial Sequence: Synthetic oligonucleotide
gugccuccuagacacccgc

SEQ ID NO: 43 - RNA, 19 nt, Artificial Sequence
  Description of Artificial Sequence: Synthetic oligonucleotide
aagccaucaucagcuuaau

SEQ ID NO: 44 - RNA, 19 nt, Artificial Sequence
  Description of Artificial Sequence: Synthetic oligonucleotide
cucucuuucaauugcagau

SEQ ID NO: 45 - RNA, 19 nt, Artificial Sequence
  Description of Artificial Sequence: Synthetic oligonucleotide
acaccauccuccaguugaa

SEQ ID NO: 46 - RNA, 19 nt, Artificial Sequence
  Description of Artificial Sequence: Synthetic oligonucleotide
uauccuaguuccauucuug

SEQ ID NO: 47 - RNA, 19 nt, Artificial Sequence
  Description of Artificial Sequence: Synthetic oligonucleotide
caaucuggucuaauugugc

SEQ ID NO: 48 - RNA, 19 nt, Artificial Sequence
  Description of Artificial Sequence: Synthetic oligonucleotide
ucaugcacucacaaagaua

SEQ ID NO: 49 - RNA, 19 nt, Artificial Sequence
  Description of Artificial Sequence: Synthetic oligonucleotide
agacacuacauuacccuaa

SEQ ID NO: 50 - RNA, 19 nt, Artificial Sequence
  Description of Artificial Sequence: Synthetic oligonucleotide
acacaagagggacuguauu

SEQ ID NO: 51 - RNA, 19 nt, Artificial Sequence
  Description of Artificial Sequence: Synthetic oligonucleotide
gaugcugaaguacaguccc

SEQ ID NO: 52 - RNA, 19 nt, Artificial Sequence
  Description of Artificial Sequence: Synthetic oligonucleotide
agccauagcuugauugcuc

SEQ ID NO: 53 - RNA, 19 nt, Artificial Sequence
  Description of Artificial Sequence: Synthetic oligonucleotide
cacaggaguccuuucuuuu

SEQ ID NO: 54 - RNA, 19 nt, Artificial Sequence
  Description of Artificial Sequence: Synthetic oligonucleotide
aucguucgauuuaagccau

SEQ ID NO: 55 - RNA, 19 nt, Artificial Sequence
  Description of Artificial Sequence: Synthetic oligonucleotide
ucaucagcuuaauuuaagu

SEQ ID NO: 56 - RNA, 19 nt, Artificial Sequence
  Description of Artificial Sequence: Synthetic oligonucleotide
agcacauuuccucucuauc

SEQ ID NO: 57 - RNA, 19 nt, Artificial Sequence
  Description of Artificial Sequence: Synthetic oligonucleotide
gugggcuauugaagauaca

SEQ ID NO: 58 - RNA, 19 nt, Artificial Sequence
  Description of Artificial Sequence: Synthetic oligonucleotide
aucauguauucccaucuag

SEQ ID NO: 59 - RNA, 19 nt, Artificial Sequence
  Description of Artificial Sequence: Synthetic oligonucleotide
aaagacacacaggaguccu

SEQ ID NO: 60 - RNA, 19 nt, Artificial Sequence
  Description of Artificial Sequence: Synthetic oligonucleotide
caaaugauacagucaggac

SEQ ID NO: 61 - RNA, 19 nt, Artificial Sequence
  Description of Artificial Sequence: Synthetic oligonucleotide
uuagaacaauuaucacaua

SEQ ID NO: 62 - RNA, 19 nt, Artificial Sequence
  Description of Artificial Sequence: Synthetic oligonucleotide
uccauucuuggucaaguuu

SEQ ID NO: 63 - RNA, 19 nt, Artificial Sequence
  Description of Artificial Sequence: Synthetic oligonucleotide
cuggucuaauugugccucc

SEQ ID NO: 64 - RNA, 19 nt, Artificial Sequence
  Description of Artificial Sequence: Synthetic oligonucleotide
cacaagagggacuguauuu

SEQ ID NO: 65 - RNA, 19 nt, Artificial Sequence
  Description of Artificial Sequence: Synthetic oligonucleotide
ucuugucucacuuuggacu

SEQ ID NO: 66 - RNA, 19 nt, Artificial Sequence
  Description of Artificial Sequence: Synthetic oligonucleotide
uuuucuauggagcaaaaca

SEQ ID NO: 67 - RNA, 19 nt, Artificial Sequence
  Description of Artificial Sequence: Synthetic oligonucleotide
auuuaaacuauucagagga

SEQ ID NO: 68 - RNA, 19 nt, Artificial Sequence
  Description of Artificial Sequence: Synthetic oligonucleotide
uuuagaacaauuaucacau

SEQ ID NO: 69 - RNA, 19 nt, Artificial Sequence
  Description of Artificial Sequence: Synthetic oligonucleotide
ggaguccuuucuuuugaaa

SEQ ID NO: 70 - RNA, 19 nt, Artificial Sequence
  Description of Artificial Sequence: Synthetic oligonucleotide
uuaagccaucaucagcuua

SEQ ID NO: 71 - RNA, 19 nt, Artificial Sequence
  Description of Artificial Sequence: Synthetic oligonucleotide
ucuaauugugccuccuaga

SEQ ID NO: 72 - RNA, 19 nt, Artificial Sequence
  Description of Artificial Sequence: Synthetic oligonucleotide
aaguacagucccagcacau

SEQ ID NO: 73 - RNA, 19 nt, Artificial Sequence
  Description of Artificial Sequence: Synthetic oligonucleotide
cugaaguacagucccagca

SEQ ID NO: 74 - RNA, 19 nt, Artificial Sequence
  Description of Artificial Sequence: Synthetic oligonucleotide
caggacggcaauaaauuag

SEQ ID NO: 75 - RNA, 19 nt, Artificial Sequence
  Description of Artificial Sequence: Synthetic oligonucleotide
acggcaauaaauuaguauu

SEQ ID NO: 76 - RNA, 19 nt, Artificial Sequence
  Description of Artificial Sequence: Synthetic oligonucleotide
agcaaucaagcuauggcug

SEQ ID NO: 77 - RNA, 19 nt, Artificial Sequence
  Description of Artificial Sequence: Synthetic oligonucleotide
ucgaacgauguguccugac

SEQ ID NO: 78 - RNA, 19 nt, Artificial Sequence
  Description of Artificial Sequence: Synthetic oligonucleotide
caauagcccaccagggaag

SEQ ID NO: 79 - RNA, 19 nt, Artificial Sequence
  Description of Artificial Sequence: Synthetic oligonucleotide
auuaggguaauguaguguc

SEQ ID NO: 80 - RNA, 19 nt, Artificial Sequence
  Description of Artificial Sequence: Synthetic oligonucleotide
ggacacgcucacacagagu

SEQ ID NO: 81 - RNA, 19 nt, Artificial Sequence
  Description of Artificial Sequence: Synthetic oligonucleotide
cuucaauagcccaccaggg

SEQ ID NO: 82 - RNA, 19 nt, Artificial Sequence
  Description of Artificial Sequence: Synthetic oligonucleotide
aggacggcaauaaauuagu

SEQ ID NO: 83 - RNA, 19 nt, Artificial Sequence
  Description of Artificial Sequence: Synthetic oligonucleotide
ugacuguaucauuugagag

SEQ ID NO: 84 - RNA, 19 nt, Artificial Sequence
  Description of Artificial Sequence: Synthetic oligonucleotide
aauuagaccagauuguacu

SEQ ID NO: 85 - RNA, 19 nt, Artificial Sequence
  Description of Artificial Sequence: Synthetic oligonucleotide
aacaagucuuaucuuugug

SEQ ID NO: 86 - RNA, 19 nt, Artificial Sequence
  Description of Artificial Sequence: Synthetic oligonucleotide
cacaauuagaccagauugu

SEQ ID NO: 87 - RNA, 19 nt, Artificial Sequence
  Description of Artificial Sequence: Synthetic oligonucleotide
cuuugugagugcaugacug

SEQ ID NO: 88 - RNA, 19 nt, Artificial Sequence
  Description of Artificial Sequence: Synthetic oligonucleotide
uuaaaucgaacgauguguc

SEQ ID NO: 89 - RNA, 19 nt, Artificial Sequence
  Description of Artificial Sequence: Synthetic oligonucleotide
aaaagguucuggguagcag

SEQ ID NO: 90 - RNA, 19 nt, Artificial Sequence
  Description of Artificial Sequence: Synthetic oligonucleotide
gcaaucaagcuauggcuga

SEQ ID NO: 91 - RNA, 19 nt, Artificial Sequence
  Description of Artificial Sequence: Synthetic oligonucleotide
guccaggacggcaauaaau

SEQ ID NO: 92 - RNA, 19 nt, Artificial Sequence
  Description of Artificial Sequence: Synthetic oligonucleotide
auuaguauuaugcaaauug

SEQ ID NO: 93 - RNA, 19 nt, Artificial Sequence
  Description of Artificial Sequence: Synthetic oligonucleotide
aaaugugcugggacuguac

SEQ ID NO: 94 - RNA, 19 nt, Artificial Sequence
  Description of Artificial Sequence: Synthetic oligonucleotide
caagcuauggcugaaggua

SEQ ID NO: 95 - RNA, 19 nt, Artificial Sequence
  Description of Artificial Sequence: Synthetic oligonucleotide
aggguaauguagugucugu

SEQ ID NO: 96 - RNA, 19 nt, Artificial Sequence
  Description of Artificial Sequence: Synthetic oligonucleotide
gacggcaauaaauuaguau

SEQ ID NO: 97 - RNA, 19 nt, Artificial Sequence
  Description of Artificial Sequence: Synthetic oligonucleotide
uguguaucuucaauagccc

SEQ ID NO: 98 - RNA, 19 nt, Artificial Sequence
  Description of Artificial Sequence: Synthetic oligonucleotide
augauggcuuaaaucgaac

SEQ ID NO: 99 - RNA, 19 nt, Artificial Sequence
  Description of Artificial Sequence: Synthetic oligonucleotide
cgggugucuaggaggcaca

SEQ ID NO: 100 - RNA, 19 nt, Artificial Sequence
  Description of Artificial Sequence: Synthetic oligonucleotide
acgcucacacagaguccag

SEQ ID NO: 101 - RNA, 19 nt, Artificial Sequence
  Description of Artificial Sequence: Synthetic oligonucleotide
ugcaauugaaagagagggu

SEQ ID NO: 102 - RNA, 19 nt, Artificial Sequence
  Description of Artificial Sequence: Synthetic oligonucleotide
uaggguaauguagugucug

SEQ ID NO: 103 - RNA, 19 nt, Artificial Sequence
  Description of Artificial Sequence: Synthetic oligonucleotide
uccaggacggcaauaaauu

SEQ ID NO: 104 - RNA, 19 nt, Artificial Sequence
  Description of Artificial Sequence: Synthetic oligonucleotide
cuguggacacgcucacaca

SEQ ID NO: 105 - RNA, 19 nt, Artificial Sequence
  Description of Artificial Sequence: Synthetic oligonucleotide
ucuucaauagcccaccagg

SEQ ID NO: 106 - RNA, 19 nt, Artificial Sequence
  Description of Artificial Sequence: Synthetic oligonucleotide
ucaagcuauggcugaaggu

SEQ ID NO: 107 - RNA, 19 nt, Artificial Sequence
  Description of Artificial Sequence: Synthetic oligonucleotide
ggacuguacuucagcaucc

SEQ ID NO: 108 - RNA, 19 nt, Artificial Sequence
  Description of Artificial Sequence: Synthetic oligonucleotide
ccaagaauggaacuaggau

SEQ ID NO: 109 - RNA, 19 nt, Artificial Sequence
  Description of Artificial Sequence: Synthetic oligonucleotide
accaagaauggaacuagga

SEQ ID NO: 110 - RNA, 19 nt, Artificial Sequence
  Description of Artificial Sequence: Synthetic oligonucleotide
uuagaccagauuguacucc

SEQ ID NO: 111 - RNA, 19 nt, Artificial Sequence
  Description of Artificial Sequence: Synthetic oligonucleotide
aagauagagaggaaaugug

SEQ ID NO: 112 - RNA, 19 nt, Artificial Sequence
  Description of Artificial Sequence: Synthetic oligonucleotide
auuuacuacaaacucugug

SEQ ID NO: 113 - RNA, 19 nt, Artificial Sequence
  Description of Artificial Sequence: Synthetic oligonucleotide
ggguaauguagugucuguu

SEQ ID NO: 114 - RNA, 19 nt, Artificial Sequence
  Description of Artificial Sequence: Synthetic oligonucleotide
gugagugcaugacugagaa

SEQ ID NO: 115 - RNA, 19 nt, Artificial Sequence
  Description of Artificial Sequence: Synthetic oligonucleotide
gcgggugucuaggaggcac

SEQ ID NO: 116 - RNA, 19 nt, Artificial Sequence
  Description of Artificial Sequence: Synthetic oligonucleotide
auuaagcugaugauggcuu

SEQ ID NO: 117 - RNA, 19 nt, Artificial Sequence
  Description of Artificial Sequence: Synthetic oligonucleotide
aucugcaauugaaagagag

SEQ ID NO: 118 - RNA, 19 nt, Artificial Sequence
  Description of Artificial Sequence: Synthetic oligonucleotide
uucaacuggaggauggugu

SEQ ID NO: 119 - RNA, 19 nt, Artificial Sequence
  Description of Artificial Sequence: Synthetic oligonucleotide
caagaauggaacuaggaua

SEQ ID NO: 120 - RNA, 19 nt, Artificial Sequence
  Description of Artificial Sequence: Synthetic oligonucleotide
gcacaauuagaccagauug

SEQ ID NO: 121 - RNA, 19 nt, Artificial Sequence
  Description of Artificial Sequence: Synthetic oligonucleotide
uaucuuugugagugcauga

SEQ ID NO: 122 - RNA, 19 nt, Artificial Sequence
  Description of Artificial Sequence: Synthetic oligonucleotide
uuaggguaauguagugucu

SEQ ID NO: 123 - RNA, 19 nt, Artificial Sequence
  Description of Artificial Sequence: Synthetic oligonucleotide
aauacagucccucuugugu

SEQ ID NO: 124 - RNA, 19 nt, Artificial Sequence
  Description of Artificial Sequence: Synthetic oligonucleotide
gggacuguacuucagcauc

SEQ ID NO: 125 - RNA, 19 nt, Artificial Sequence
  Description of Artificial Sequence: Synthetic oligonucleotide
gagcaaucaagcuauggcu

SEQ ID NO: 126 - RNA, 19 nt, Artificial Sequence
  Description of Artificial Sequence: Synthetic oligonucleotide
aaaagaaaggacuccugug

SEQ ID NO: 127 - RNA, 19 nt, Artificial Sequence
  Description of Artificial Sequence: Synthetic oligonucleotide
auggcuuaaaucgaacgau

SEQ ID NO: 128 - RNA, 19 nt, Artificial Sequence
  Description of Artificial Sequence: Synthetic oligonucleotide
acuuaaauuaagcugauga

SEQ ID NO: 129 - RNA, 19 nt, Artificial Sequence
  Description of Artificial Sequence: Synthetic oligonucleotide
gauagagaggaaaugugcu

SEQ ID NO: 130 - RNA, 19 nt, Artificial Sequence
  Description of Artificial Sequence: Synthetic oligonucleotide
uguaucuucaauagcccac

SEQ ID NO: 131 - RNA, 19 nt, Artificial Sequence
  Description of Artificial Sequence: Synthetic oligonucleotide
cuagaugggaauacaugau

SEQ ID NO: 132 - RNA, 19 nt, Artificial Sequence
  Description of Artificial Sequence: Synthetic oligonucleotide
aggacuccugugugucuuu

SEQ ID NO: 133 - RNA, 19 nt, Artificial Sequence
  Description of Artificial Sequence: Synthetic oligonucleotide
guccugacuguaucauuug

SEQ ID NO: 134 - RNA, 19 nt, Artificial Sequence
  Description of Artificial Sequence: Synthetic oligonucleotide
uaugugauaauuguucuaa

SEQ ID NO: 135 - RNA, 19 nt, Artificial Sequence
  Description of Artificial Sequence: Synthetic oligonucleotide
aaacuugaccaagaaugga

SEQ ID NO: 136 - RNA, 19 nt, Artificial Sequence
  Description of Artificial Sequence: Synthetic oligonucleotide
ggaggcacaauuagaccag

SEQ ID NO: 137 - RNA, 19 nt, Artificial Sequence
  Description of Artificial Sequence: Synthetic oligonucleotide
aaauacagucccucuugug

SEQ ID NO: 138 - RNA, 19 nt, Artificial Sequence
  Description of Artificial Sequence: Synthetic oligonucleotide
aguccaaagugagacaaga

SEQ ID NO: 139 - RNA, 19 nt, Artificial Sequence
  Description of Artificial Sequence: Synthetic oligonucleotide
uguuuugcuccauagaaaa

SEQ ID NO: 140 - RNA, 19 nt, Artificial Sequence
  Description of Artificial Sequence: Synthetic oligonucleotide
uccucugaauaguuuaaau

SEQ ID NO: 141 - RNA, 19 nt, Artificial Sequence
  Description of Artificial Sequence: Synthetic oligonucleotide
augugauaauuguucuaaa

SEQ ID NO: 142 - RNA, 19 nt, Artificial Sequence
  Description of Artificial Sequence: Synthetic oligonucleotide
uuucaaaagaaaggacucc

SEQ ID NO: 143 - RNA, 19 nt, Artificial Sequence
  Description of Artificial Sequence: Synthetic oligonucleotide
uaagcugaugauggcuuaa

SEQ ID NO: 144 - RNA, 19 nt, Artificial Sequence
  Description of Artificial Sequence: Synthetic oligonucleotide
ucuaggaggcacaauuaga

SEQ ID NO: 145 - RNA, 19 nt, Artificial Sequence
  Description of Artificial Sequence: Synthetic oligonucleotide
augugcugggacuguacuu

SEQ ID NO: 146 - RNA, 19 nt, Artificial Sequence
  Description of Artificial Sequence: Synthetic oligonucleotide
ugcugggacuguacuucag

SEQ ID NO: 147 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuaauuuauugccguccugnn

SEQ ID NO: 148 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caggacggcaauaaauuagnn

SEQ ID NO: 149 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aauacuaauuuauugccgunn

SEQ ID NO: 150 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acggcaauaaauuaguauunn

SEQ ID NO: 151 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cagccauagcuugauugcunn

SEQ ID NO: 152 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agcaaucaagcuauggcugnn

SEQ ID NO: 153 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gucaggacacaucguucgann

SEQ ID NO: 154 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucgaacgauguguccugacnn

SEQ ID NO: 155 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuucccuggugggcuauugnn

SEQ ID NO: 156 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caauagcccaccagggaagnn

SEQ ID NO: 157 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gacacuacauuacccuaaunn

SEQ ID NO: 158 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuaggguaauguagugucnn

SEQ ID NO: 159 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acucugugugagcguguccnn

SEQ ID NO: 160 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggacacgcucacacagagunn

SEQ ID NO: 161 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cccuggugggcuauugaagnn

SEQ ID NO: 162 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuucaauagcccaccagggnn

SEQ ID NO: 163 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acuaauuuauugccguccunn

SEQ ID NO: 164 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aggacggcaauaaauuagunn

SEQ ID NO: 165 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cucucaaaugauacagucann

SEQ ID NO: 166 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugacuguaucauuugagagnn

SEQ ID NO: 167 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aguacaaucuggucuaauunn

SEQ ID NO: 168 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aauuagaccagauuguacunn

SEQ ID NO: 169 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacaaagauaagacuuguunn

SEQ ID NO: 170 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aacaagucuuaucuuugugnn

SEQ ID NO: 171 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acaaucuggucuaauugugnn

SEQ ID NO: 172 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacaauuagaccagauugunn

SEQ ID NO: 173 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cagucaugcacucacaaagnn

SEQ ID NO: 174 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuuugugagugcaugacugnn

SEQ ID NO: 175 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gacacaucguucgauuuaann

SEQ ID NO: 176 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuaaaucgaacgaugugucnn

SEQ ID NO: 177 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cugcuacccagaaccuuuunn

SEQ ID NO: 178 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaaagguucuggguagcagnn

SEQ ID NO: 179 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucagccauagcuugauugcnn

SEQ ID NO: 180 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gcaaucaagcuauggcugann

SEQ ID NO: 181 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuuauugccguccuggacnn

SEQ ID NO: 182 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guccaggacggcaauaaaunn

SEQ ID NO: 183 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caauuugcauaauacuaaunn

SEQ ID NO: 184 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuaguauuaugcaaauugnn

SEQ ID NO: 185 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guacagucccagcacauuunn

SEQ ID NO: 186 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaaugugcugggacuguacnn

SEQ ID NO: 187 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaccuucagccauagcuugnn

SEQ ID NO: 188 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caagcuauggcugaagguann

SEQ ID NO: 189 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acagacacuacauuacccunn

SEQ ID NO: 190 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aggguaauguagugucugunn

SEQ ID NO: 191 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auacuaauuuauugccgucnn

SEQ ID NO: 192 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gacggcaauaaauuaguaunn

SEQ ID NO: 193 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gggcuauugaagauacacann

SEQ ID NO: 194 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uguguaucuucaauagcccnn

SEQ ID NO: 195 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guucgauuuaagccaucaunn

SEQ ID NO: 196 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
augauggcuuaaaucgaacnn

SEQ ID NO: 197 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugugccuccuagacacccgnn

SEQ ID NO: 198 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cgggugucuaggaggcacann

SEQ ID NO: 199 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuggacucugugugagcgunn

SEQ ID NO: 200 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acgcucacacagaguccagnn

SEQ ID NO: 201 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acccucucuuucaauugcann

SEQ ID NO: 202 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugcaauugaaagagagggunn

SEQ ID NO: 203 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cagacacuacauuacccuann

SEQ ID NO: 204 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaggguaauguagugucugnn

SEQ ID NO: 205 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aauuuauugccguccuggann

SEQ ID NO: 206 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uccaggacggcaauaaauunn

SEQ ID NO: 207 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugugugagcguguccacagnn

SEQ ID NO: 208 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuguggacacgcucacacann

SEQ ID NO: 209 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ccuggugggcuauugaagann

SEQ ID NO: 210 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucuucaauagcccaccaggnn

SEQ ID NO: 211 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
accuucagccauagcuugann

SEQ ID NO: 212 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucaagcuauggcugaaggunn

SEQ ID NO: 213 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaugcugaaguacaguccnn

SEQ ID NO: 214 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggacuguacuucagcauccnn

SEQ ID NO: 215 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auccuaguuccauucuuggnn

SEQ ID NO: 216 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ccaagaauggaacuaggaunn

SEQ ID NO: 217 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uccuaguuccauucuuggunn

SEQ ID NO: 218 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
accaagaauggaacuaggann

SEQ ID NO: 219 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaguacaaucuggucuaann

SEQ ID NO: 220 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuagaccagauuguacuccnn

SEQ ID NO: 221 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacauuuccucucuaucuunn

SEQ ID NO: 222 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aagauagagaggaaaugugnn

SEQ ID NO: 223 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacagaguuuguaguaaaunn

SEQ ID NO: 224 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuuacuacaaacucugugnn

SEQ ID NO: 225 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aacagacacuacauuacccnn

SEQ ID NO: 226 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggguaauguagugucuguunn

SEQ ID NO: 227 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uucucagucaugcacucacnn

SEQ ID NO: 228 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gugagugcaugacugagaann

SEQ ID NO: 229 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gugccuccuagacacccgcnn

SEQ ID NO: 230 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gcgggugucuaggaggcacnn

SEQ ID NO: 231 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aagccaucaucagcuuaaunn

SEQ ID NO: 232 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuaagcugaugauggcuunn

SEQ ID NO: 233 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cucucuuucaauugcagaunn

SEQ ID NO: 234 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aucugcaauugaaagagagnn

SEQ ID NO: 235 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acaccauccuccaguugaann

SEQ ID NO: 236 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uucaacuggaggauggugunn

SEQ ID NO: 237 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uauccuaguuccauucuugnn

SEQ ID NO: 238 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caagaauggaacuaggauann

SEQ ID NO: 239 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caaucuggucuaauugugcnn

SEQ ID NO: 240 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gcacaauuagaccagauugnn

SEQ ID NO: 241 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucaugcacucacaaagauann

SEQ ID NO: 242 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaucuuugugagugcaugann

SEQ ID NO: 243 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agacacuacauuacccuaann

SEQ ID NO: 244 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuaggguaauguagugucunn

SEQ ID NO: 245 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acacaagagggacuguauunn

SEQ ID NO: 246 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aauacagucccucuugugunn

SEQ ID NO: 247 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gaugcugaaguacagucccnn

SEQ ID NO: 248 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gggacuguacuucagcaucnn

SEQ ID NO: 249 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agccauagcuugauugcucnn

SEQ ID NO: 250 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gagcaaucaagcuauggcunn

SEQ ID NO: 251 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacaggaguccuuucuuuunn

SEQ ID NO: 252 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaaagaaaggacuccugugnn

SEQ ID NO: 253 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aucguucgauuuaagccaunn

SEQ ID NO: 254 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auggcuuaaaucgaacgaunn

SEQ ID NO: 255 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucaucagcuuaauuuaagunn

SEQ ID NO: 256 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acuuaaauuaagcugaugann

SEQ ID NO: 257 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agcacauuuccucucuaucnn

SEQ ID NO: 258 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gauagagaggaaaugugcunn

SEQ ID NO: 259 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gugggcuauugaagauacann

SEQ ID NO: 260 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uguaucuucaauagcccacnn

SEQ ID NO: 261 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aucauguauucccaucuagnn

SEQ ID NO: 262 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuagaugggaauacaugaunn

SEQ ID NO: 263 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaagacacacaggaguccunn

SEQ ID NO: 264 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aggacuccugugugucuuunn

SEQ ID NO: 265 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caaaugauacagucaggacnn

SEQ ID NO: 266 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guccugacuguaucauuugnn

SEQ ID NO: 267 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuagaacaauuaucacauann

SEQ ID NO: 268 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaugugauaauuguucuaann

SEQ ID NO: 269 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uccauucuuggucaaguuunn

SEQ ID NO: 270 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaacuugaccaagaauggann

SEQ ID NO: 271 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuggucuaauugugccuccnn

SEQ ID NO: 272 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaggcacaauuagaccagnn

SEQ ID NO: 273 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacaagagggacuguauuunn

SEQ ID NO: 274 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaauacagucccucuugugnn

SEQ ID NO: 275 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucuugucucacuuuggacunn

SEQ ID NO: 276 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aguccaaagugagacaagann

SEQ ID NO: 277 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuuucuauggagcaaaacann

SEQ ID NO: 278 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uguuuugcuccauagaaaann

SEQ ID NO: 279 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuuaaacuauucagaggann

SEQ ID NO: 280 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uccucugaauaguuuaaaunn

SEQ ID NO: 281 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuuagaacaauuaucacaunn

SEQ ID NO: 282 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
augugauaauuguucuaaann

SEQ ID NO: 283 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaguccuuucuuuugaaann

SEQ ID NO: 284 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuucaaaagaaaggacuccnn

SEQ ID NO: 285 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuaagccaucaucagcuuann

SEQ ID NO: 286 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaagcugaugauggcuuaann

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucuaauugugccuccuagann

SEQ ID NO: 288 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucuaggaggcacaauuagann

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaguacagucccagcacaunn

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
augugcugggacuguacuunn

SEQ ID NO: 291 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cugaaguacagucccagcann

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugcugggacuguacuucagnn

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 294 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 295 - DNA, 21 bp, Artificial Sequence
  Description of Artificial Sequence: Synthetic oligonucleotide
  Description of Combined DNA/RNA Molecule: Synthetic oligonucleotide
aauacuaauuuauugccgutt

SEQ ID NO: 296 - DNA, 21 bp, Artificial Sequence
  Description of Artificial Sequence: Synthetic oligonucleotide
  Description of Combined DNA/RNA Molecule: Synthetic oligonucleotide
acggcaauaaauuaguauutt

SEQ ID NO: 297 - DNA, 21 bp, Artificial Sequence
  Description of Artificial Sequence: Synthetic oligonucleotide
  Description of Combined DNA/RNA Molecule: Synthetic oligonucleotide
cagccauagcuugauugcutt

SEQ ID NO: 298 - DNA, 21 bp, Artificial Sequence
  Description of Artificial Sequence: Synthetic oligonucleotide
  Description of Combined DNA/RNA Molecule: Synthetic oligonucleotide
agcaaucaagcuauggcugtt

SEQ ID NO: 299 - DNA, 21 bp, Artificial Sequence
  Description of Artificial Sequence: Synthetic oligonucleotide
  Description of Combined DNA/RNA Molecule: Synthetic oligonucleotide
gucaggacacaucguucgatt

SEQ ID NO: 300 - DNA, 21 bp, Artificial Sequence
  Description of Artificial Sequence: Synthetic oligonucleotide
  Description of Combined DNA/RNA Molecule: Synthetic oligonucleotide
ucgaacgauguguccugactt

SEQ ID NO: 301 - DNA, 21 bp, Artificial Sequence
  Description of Artificial Sequence: Synthetic oligonucleotide
  Description of Combined DNA/RNA Molecule: Synthetic oligonucleotide
cuucccuggugggcuauugtt

SEQ ID NO: 302 - DNA, 21 bp, Artificial Sequence
  Description of Artificial Sequence: Synthetic oligonucleotide
  Description of Combined DNA/RNA Molecule: Synthetic oligonucleotide
caauagcccaccagggaagtt

SEQ ID NO: 303 - DNA, 21 bp, Artificial Sequence
  Description of Artificial Sequence: Synthetic oligonucleotide
  Description of Combined DNA/RNA Molecule: Synthetic oligonucleotide
gacacuacauuacccuaautt

SEQ ID NO: 304 - DNA, 21 bp, Artificial Sequence
  Description of Artificial Sequence: Synthetic oligonucleotide
  Description of Combined DNA/RNA Molecule: Synthetic oligonucleotide
auuaggguaauguaguguctt

SEQ ID NO: 305 - DNA, 21 bp, Artificial Sequence
  Description of Artificial Sequence: Synthetic oligonucleotide
  Description of Combined DNA/RNA Molecule: Synthetic oligonucleotide
acucugugugagcgugucctt

SEQ ID NO: 306 - DNA, 21 bp, Artificial Sequence
  Description of Artificial Sequence: Synthetic oligonucleotide
  Description of Combined DNA/RNA Molecule: Synthetic oligonucleotide
ggacacgcucacacagagutt

SEQ ID NO: 307 - DNA, 21 bp, Artificial Sequence
  Description of Artificial Sequence: Synthetic oligonucleotide
  Description of Combined DNA/RNA Molecule: Synthetic oligonucleotide
cccuggugggcuauugaagtt

SEQ ID NO: 308 - DNA, 21 bp, Artificial Sequence
  Description of Artificial Sequence: Synthetic oligonucleotide
  Description of Combined DNA/RNA Molecule: Synthetic oligonucleotide
cuucaauagcccaccagggtt

SEQ ID NO: 309 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 310 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 311 - DNA, 21 bp, Artificial Sequence
  Description of Artificial Sequence: Synthetic oligonucleotide
  Description of Combined DNA/RNA Molecule: Synthetic oligonucleotide
cucucaaaugauacagucatt

SEQ ID NO: 312 - DNA, 21 bp, Artificial Sequence
  Description of Artificial Sequence: Synthetic oligonucleotide
  Description of Combined DNA/RNA Molecule: Synthetic oligonucleotide
ugacuguaucauuugagagtt

SEQ ID NO: 313 - DNA, 21 bp, Artificial Sequence
  Description of Artificial Sequence: Synthetic oligonucleotide
  Description of Combined DNA/RNA Molecule: Synthetic oligonucleotide
aguacaaucuggucuaauutt

SEQ ID NO: 314 - DNA, 21 bp, Artificial Sequence
  Description of Artificial Sequence: Synthetic oligonucleotide
  Description of Combined DNA/RNA Molecule: Synthetic oligonucleotide
aauuagaccagauuguacutt

SEQ ID NO: 315 - DNA, 21 bp, Artificial Sequence
  Description of Artificial Sequence: Synthetic oligonucleotide
  Description of Combined DNA/RNA Molecule: Synthetic oligonucleotide
cacaaagauaagacuuguutt

SEQ ID NO: 316 - DNA, 21 bp, Artificial Sequence
  Description of Artificial Sequence: Synthetic oligonucleotide
  Description of Combined DNA/RNA Molecule: Synthetic oligonucleotide
aacaagucuuaucuuugugtt

SEQ ID NO: 317 - DNA, 21 bp, Artificial Sequence
  Description of Artificial Sequence: Synthetic oligonucleotide
  Description of Combined DNA/RNA Molecule: Synthetic oligonucleotide
acaaucuggucuaauugugtt

SEQ ID NO: 318 - DNA, 21 bp, Artificial Sequence
  Description of Artificial Sequence: Synthetic oligonucleotide
  Description of Combined DNA/RNA Molecule: Synthetic oligonucleotide
cacaauuagaccagauugutt

SEQ ID NO: 319 - DNA, 21 bp, Artificial Sequence
  Description of Artificial Sequence: Synthetic oligonucleotide
  Description of Combined DNA/RNA Molecule: Synthetic oligonucleotide
cagucaugcacucacaaagtt

SEQ ID NO: 320 - DNA, 21 bp, Artificial Sequence
  Description of Artificial Sequence: Synthetic oligonucleotide
  Description of Combined DNA/RNA Molecule: Synthetic oligonucleotide
cuuugugagugcaugacugtt

SEQ ID NO: 321 - DNA, 21 bp, Artificial Sequence
  Description of Artificial Sequence: Synthetic oligonucleotide
  Description of Combined DNA/RNA Molecule: Synthetic oligonucleotide
gacacaucguucgauuuaatt

SEQ ID NO: 322 - DNA, 21 bp, Artificial Sequence
  Description of Artificial Sequence: Synthetic oligonucleotide
  Description of Combined DNA/RNA Molecule: Synthetic oligonucleotide
uuaaaucgaacgauguguctt

SEQ ID NO: 323 - DNA, 21 bp, Artificial Sequence
  Description of Artificial Sequence: Synthetic oligonucleotide
  Description of Combined DNA/RNA Molecule: Synthetic oligonucleotide
cugcuacccagaaccuuuutt

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
aaaagguucuggguagcagtt

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
ucagccauagcuugauugctt

SEQ ID NO: 326 - DNA, 21 bp, Artificial Sequence
  Description of Artificial Sequence: Synthetic oligonucleotide
  Description of Combined DNA/RNA Molecule: Synthetic oligonucleotide
gcaaucaagcuauggcugatt

SEQ ID NO: 327 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
caauuugcauaauacuaautt

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
auuaguauuaugcaaauugtt

SEQ ID NO: 331 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 332 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 333 - DNA, 21 bp, Artificial Sequence
  Description of Artificial Sequence: Synthetic oligonucleotide
  Description of Combined DNA/RNA Molecule: Synthetic oligonucleotide
uaccuucagccauagcuugtt

SEQ ID NO: 334 - DNA, 21 bp, Artificial Sequence
  Description of Artificial Sequence: Synthetic oligonucleotide
  Description of Combined DNA/RNA Molecule: Synthetic oligonucleotide
caagcuauggcugaagguatt

SEQ ID NO: 335 - DNA, 21 bp, Artificial Sequence
  Description of Artificial Sequence: Synthetic oligonucleotide
  Description of Combined DNA/RNA Molecule: Synthetic oligonucleotide
acagacacuacauuacccutt

SEQ ID NO: 336 - DNA, 21 bp, Artificial Sequence
  Description of Artificial Sequence: Synthetic oligonucleotide
  Description of Combined DNA/RNA Molecule: Synthetic oligonucleotide
aggguaauguagugucugutt

SEQ ID NO: 337 - DNA, 21 bp, Artificial Sequence
  Description of Artificial Sequence: Synthetic oligonucleotide
  Description of Combined DNA/RNA Molecule: Synthetic oligonucleotide
auacuaauuuauugccguctt

SEQ ID NO: 338 - DNA, 21 bp, Artificial Sequence
  Description of Artificial Sequence: Synthetic oligonucleotide
  Description of Combined DNA/RNA Molecule: Synthetic oligonucleotide
gacggcaauaaauuaguautt

SEQ ID NO: 339 - DNA, 21 bp, Artificial Sequence
  Description of Artificial Sequence: Synthetic oligonucleotide
  Description of Combined DNA/RNA Molecule: Synthetic oligonucleotide
gggcuauugaagauacacatt

SEQ ID NO: 340 - DNA, 21 bp, Artificial Sequence
  Description of Artificial Sequence: Synthetic oligonucleotide
  Description of Combined DNA/RNA Molecule: Synthetic oligonucleotide
uguguaucuucaauagccctt

SEQ ID NO: 341 - DNA, 21 bp, Artificial Sequence
  Description of Artificial Sequence: Synthetic oligonucleotide
  Description of Combined DNA/RNA Molecule: Synthetic oligonucleotide
guucgauuuaagccaucautt

SEQ ID NO: 342 - DNA, 21 bp, Artificial Sequence
  Description of Artificial Sequence: Synthetic oligonucleotide
  Description of Combined DNA/RNA Molecule: Synthetic oligonucleotide
augauggcuuaaaucgaactt

SEQ ID NO: 343 - DNA, 21 bp, Artificial Sequence
  Description of Artificial Sequence: Synthetic oligonucleotide
  Description of Combined DNA/RNA Molecule: Synthetic oligonucleotide
ugugccuccuagacacccgtt

SEQ ID NO: 344 - DNA, 21 bp, Artificial Sequence
  Description of Artificial Sequence: Synthetic oligonucleotide
  Description of Combined DNA/RNA Molecule: Synthetic oligonucleotide
cgggugucuaggaggcacatt

SEQ ID NO: 345 - DNA, 21 bp, Artificial Sequence
  Description of Artificial Sequence: Synthetic oligonucleotide
  Description of Combined DNA/RNA Molecule: Synthetic oligonucleotide
cuggacucugugugagcgutt

SEQ ID NO: 346 - DNA, 21 bp, Artificial Sequence
  Description of Artificial Sequence: Synthetic oligonucleotide
  Description of Combined DNA/RNA Molecule: Synthetic oligonucleotide
acgcucacacagaguccagtt

SEQ ID NO: 347 - DNA, 21 bp, Artificial Sequence
  Description of Artificial Sequence: Synthetic oligonucleotide
  Description of Combined DNA/RNA Molecule: Synthetic oligonucleotide
acccucucuuucaauugcatt

SEQ ID NO: 348 - DNA, 21 bp, Artificial Sequence
  Description of Artificial Sequence: Synthetic oligonucleotide
  Description of Combined DNA/RNA Molecule: Synthetic oligonucleotide
ugcaauugaaagagagggutt

SEQ ID NO: 349 - DNA, 21 bp, Artificial Sequence
  Description of Artificial Sequence: Synthetic oligonucleotide
  Description of Combined DNA/RNA Molecule: Synthetic oligonucleotide
cagacacuacauuacccuatt

SEQ ID NO: 350 - DNA, 21 bp, Artificial Sequence
  Description of Artificial Sequence: Synthetic oligonucleotide
  Description of Combined DNA/RNA Molecule: Synthetic oligonucleotide
uaggguaauguagugucugtt

SEQ ID NO: 351 - DNA, 21 bp, Artificial Sequence
  Description of Artificial Sequence: Synthetic oligonucleotide
  Description of Combined DNA/RNA Molecule: Synthetic oligonucleotide
aauuuauugccguccuggatt

SEQ ID NO: 352 - DNA, 21 bp, Artificial Sequence
  Description of Artificial Sequence: Synthetic oligonucleotide
  Description of Combined DNA/RNA Molecule: Synthetic oligonucleotide
uccaggacggcaauaaauutt

SEQ ID NO: 353 - DNA, 21 bp, Artificial Sequence
  Description of Artificial Sequence: Synthetic oligonucleotide
  Description of Combined DNA/RNA Molecule: Synthetic oligonucleotide
ugugugagcguguccacagtt

SEQ ID NO: 354 - DNA, 21 bp, Artificial Sequence
  Description of Artificial Sequence: Synthetic oligonucleotide
  Description of Combined DNA/RNA Molecule: Synthetic oligonucleotide
cuguggacacgcucacacatt

SEQ ID NO: 355 - DNA, 21 bp, Artificial Sequence
  Description of Artificial Sequence: Synthetic oligonucleotide
  Description of Combined DNA/RNA Molecule: Synthetic oligonucleotide
ccuggugggcuauugaagatt

SEQ ID NO: 356 - DNA, 21 bp, Artificial Sequence
  Description of Artificial Sequence: Synthetic oligonucleotide
  Description of Combined DNA/RNA Molecule: Synthetic oligonucleotide
ucuucaauagcccaccaggtt

SEQ ID NO: 357 - DNA, 21 bp, Artificial Sequence
  Description of Artificial Sequence: Synthetic oligonucleotide
  Description of Combined DNA/RNA Molecule: Synthetic oligonucleotide
accuucagccauagcuugatt

SEQ ID NO: 358 - DNA, 21 bp, Artificial Sequence
  Description of Artificial Sequence: Synthetic oligonucleotide
  Description of Combined DNA/RNA Molecule: Synthetic oligonucleotide
ucaagcuauggcugaaggutt

SEQ ID NO: 359 - DNA, 21 bp, Artificial Sequence
  Description of Artificial Sequence: Synthetic oligonucleotide
  Description of Combined DNA/RNA Molecule: Synthetic oligonucleotide
ggaugcugaaguacagucctt

SEQ ID NO: 360 - DNA, 21 bp, Artificial Sequence
  Description of Artificial Sequence: Synthetic oligonucleotide
  Description of Combined DNA/RNA Molecule: Synthetic oligonucleotide
ggacuguacuucagcaucctt

SEQ ID NO: 361 - DNA, 21 bp, Artificial Sequence
  Description of Artificial Sequence: Synthetic oligonucleotide
  Description of Combined DNA/RNA Molecule: Synthetic oligonucleotide
auccuaguuccauucuuggtt

SEQ ID NO: 362 - DNA, 21 bp, Artificial Sequence
  Description of Artificial Sequence: Synthetic oligonucleotide
  Description of Combined DNA/RNA Molecule: Synthetic oligonucleotide
ccaagaauggaacuaggautt

SEQ ID NO: 363 - DNA, 21 bp, Artificial Sequence
  Description of Artificial Sequence: Synthetic oligonucleotide
  Description of Combined DNA/RNA Molecule: Synthetic oligonucleotide
uccuaguuccauucuuggutt

SEQ ID NO: 364 - DNA, 21 bp, Artificial Sequence
  Description of Artificial Sequence: Synthetic oligonucleotide
  Description of Combined DNA/RNA Molecule: Synthetic oligonucleotide
accaagaauggaacuaggatt

SEQ ID NO: 365 - DNA, 21 bp, Artificial Sequence
  Description of Artificial Sequence: Synthetic oligonucleotide
  Description of Combined DNA/RNA Molecule: Synthetic oligonucleotide
ggaguacaaucuggucuaatt

SEQ ID NO: 366 - DNA, 21 bp, Artificial Sequence
  Description of Artificial Sequence: Synthetic oligonucleotide
  Description of Combined DNA/RNA Molecule: Synthetic oligonucleotide
uuagaccagauuguacucctt

SEQ ID NO: 367 - DNA, 21 bp, Artificial Sequence
  Description of Artificial Sequence: Synthetic oligonucleotide
  Description of Combined DNA/RNA Molecule: Synthetic oligonucleotide
cacauuuccucucuaucuutt

SEQ ID NO: 368 - DNA, 21 bp, Artificial Sequence
  Description of Artificial Sequence: Synthetic oligonucleotide
  Description of Combined DNA/RNA Molecule: Synthetic oligonucleotide
aagauagagaggaaaugugtt

SEQ ID NO: 369 - DNA, 21 bp, Artificial Sequence
  Description of Artificial Sequence: Synthetic oligonucleotide
  Description of Combined DNA/RNA Molecule: Synthetic oligonucleotide
cacagaguuuguaguaaautt

SEQ ID NO: 370 - DNA, 21 bp, Artificial Sequence
  Description of Artificial Sequence: Synthetic oligonucleotide
  Description of Combined DNA/RNA Molecule: Synthetic oligonucleotide
auuuacuacaaacucugugtt

SEQ ID NO: 371 - DNA, 21 bp, Artificial Sequence
  Description of Artificial Sequence: Synthetic oligonucleotide
  Description of Combined DNA/RNA Molecule: Synthetic oligonucleotide
aacagacacuacauuaccctt

SEQ ID NO: 372 - DNA, 21 bp, Artificial Sequence
  Description of Artificial Sequence: Synthetic oligonucleotide
  Description of Combined DNA/RNA Molecule: Synthetic oligonucleotide
ggguaauguagugucuguutt

SEQ ID NO: 373 - DNA, 21 bp, Artificial Sequence
  Description of Artificial Sequence: Synthetic oligonucleotide
  Description of Combined DNA/RNA Molecule: Synthetic oligonucleotide
uucucagucaugcacucactt

SEQ ID NO: 374 - DNA, 21 bp, Artificial Sequence
  Description of Artificial Sequence: Synthetic oligonucleotide
  Description of Combined DNA/RNA Molecule: Synthetic oligonucleotide
gugagugcaugacugagaatt

SEQ ID NO: 375 - DNA, 21 bp, Artificial Sequence
  Description of Artificial Sequence: Synthetic oligonucleotide
  Description of Combined DNA/RNA Molecule: Synthetic oligonucleotide
gugccuccuagacacccgctt

SEQ ID NO: 376 - DNA, 21 bp, Artificial Sequence
  Description of Artificial Sequence: Synthetic oligonucleotide
  Description of Combined DNA/RNA Molecule: Synthetic oligonucleotide
gcgggugucuaggaggcactt

SEQ ID NO: 377 - DNA, 21 bp, Artificial Sequence
  Description of Artificial Sequence: Synthetic oligonucleotide
  Description of Combined DNA/RNA Molecule: Synthetic oligonucleotide
aagccaucaucagcuuaautt

SEQ ID NO: 378 - DNA, 21 bp, Artificial Sequence
  Description of Artificial Sequence: Synthetic oligonucleotide
  Description of Combined DNA/RNA Molecule: Synthetic oligonucleotide
auuaagcugaugauggcuutt

SEQ ID NO: 379 - DNA, 21 bp, Artificial Sequence
  Description of Artificial Sequence: Synthetic oligonucleotide
  Description of Combined DNA/RNA Molecule: Synthetic oligonucleotide
cucucuuucaauugcagautt

SEQ ID NO: 380 - DNA, 21 bp, Artificial Sequence
  Description of Artificial Sequence: Synthetic oligonucleotide
  Description of Combined DNA/RNA Molecule: Synthetic oligonucleotide
aucugcaauugaaagagagtt

SEQ ID NO: 381 - DNA, 21 bp, Artificial Sequence
  Description of Artificial Sequence: Synthetic oligonucleotide
  Description of Combined DNA/RNA Molecule: Synthetic oligonucleotide
acaccauccuccaguugaatt

SEQ ID NO: 382 - DNA, 21 bp, Artificial Sequence
  Description of Artificial Sequence: Synthetic oligonucleotide
  Description of Combined DNA/RNA Molecule: Synthetic oligonucleotide
uucaacuggaggauggugutt

SEQ ID NO: 383 - DNA, 21 bp, Artificial Sequence
  Description of Artificial Sequence: Synthetic oligonucleotide
  Description of Combined DNA/RNA Molecule: Synthetic oligonucleotide
uauccuaguuccauucuugtt

SEQ ID NO: 384 - DNA, 21 bp, Artificial Sequence
  Description of Artificial Sequence: Synthetic oligonucleotide
  Description of Combined DNA/RNA Molecule: Synthetic oligonucleotide
caagaauggaacuaggauatt

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
caaucuggucuaauugugctt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
gcacaauuagaccagauugtt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
ucaugcacucacaaagauatt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
uaucuuugugagugcaugatt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
agacacuacauuacccuaatt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
uuaggguaauguagugucutt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
acacaagagggacuguauutt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
aauacagucccucuugugutt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
gaugcugaaguacaguccctt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
gggacuguacuucagcauctt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
agccauagcuugauugcuctt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
gagcaaucaagcuauggcutt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
cacaggaguccuuucuuuutt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
aaaagaaaggacuccugugtt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
aucguucgauuuaagccautt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
auggcuuaaaucgaacgautt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
ucaucagcuuaauuuaagutt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
acuuaaauuaagcugaugatt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
agcacauuuccucucuauctt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
gauagagaggaaaugugcutt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
gugggcuauugaagauacatt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
uguaucuucaauagcccactt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
aucauguauucccaucuagtt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
cuagaugggaauacaugautt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
aaagacacacaggaguccutt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
aggacuccugugugucuuutt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
caaaugauacagucaggactt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
guccugacuguaucauuugtt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
uuagaacaauuaucacauatt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
uaugugauaauuguucuaatt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
uccauucuuggucaaguuutt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
aaacuugaccaagaauggatt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
cuggucuaauugugccucctt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
ggaggcacaauuagaccagtt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
cacaagagggacuguauuutt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
aaauacagucccucuugugtt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
ucuugucucacuuuggacutt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
aguccaaagugagacaagatt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
uuuucuauggagcaaaacatt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
uguuuugcuccauagaaaatt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
uuuagaacaauuaucacautt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
augugauaauuguucuaaatt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
ggaguccuuucuuuugaaatt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
uuucaaaagaaaggacucctt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
uuaagccaucaucagcuuatt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
uaagcugaugauggcuuaatt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
ucuaauugugccuccuagatt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
ucuaggaggcacaauuagatt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
aaguacagucccagcacautt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
augugcugggacuguacuutt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
cugaaguacagucccagcatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
ugcugggacuguacuucagtt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
aauacuaauuuauugccgutt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
acggcaauaaauuaguauutt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
cagccauagcuugauugcutt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
agcaaucaagcuauggcugtt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
gucaggacacaucguucgatt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
ucgaacgauguguccugactt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
cuucccuggugggcuauugtt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
caauagcccaccagggaagtt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
gacacuacauuacccuaautt

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
auuaggguaauguaguguctt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
acucugugugagcgugucctt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
ggacacgcucacacagagutt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
cccuggugggcuauugaagtt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
cuucaauagcccaccagggtt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
cucucaaaugauacagucatt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
ugacuguaucauuugagagtt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
aguacaaucuggucuaauutt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
aauuagaccagauuguacutt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
cacaaagauaagacuuguutt

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
aacaagucuuaucuuugugtt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
acaaucuggucuaauugugtt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
cacaauuagaccagauugutt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
cagucaugcacucacaaagtt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
cuuugugagugcaugacugtt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
gacacaucguucgauuuaatt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
uuaaaucgaacgauguguctt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
cugcuacccagaaccuuuutt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
aaaagguucuggguagcagtt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
ucagccauagcuugauugctt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
gcaaucaagcuauggcugatt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
caauuugcauaauacuaautt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
auuaguauuaugcaaauugtt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
uaccuucagccauagcuugtt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
caagcuauggcugaagguatt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
acagacacuacauuacccutt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
aggguaauguagugucugutt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
auacuaauuuauugccguctt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
gacggcaauaaauuaguautt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
gggcuauugaagauacacatt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
uguguaucuucaauagccctt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
guucgauuuaagccaucautt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
augauggcuuaaaucgaactt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
ugugccuccuagacacccgtt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
cgggugucuaggaggcacatt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
cuggacucugugugagcgutt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
acgcucacacagaguccagtt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
acccucucuuucaauugcatt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
ugcaauugaaagagagggutt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
cagacacuacauuacccuatt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
uaggguaauguagugucugtt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
aauuuauugccguccuggatt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
uccaggacggcaauaaauutt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
ugugugagcguguccacagtt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
cuguggacacgcucacacatt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
ccuggugggcuauugaagatt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
ucuucaauagcccaccaggtt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
accuucagccauagcuugatt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
ucaagcuauggcugaaggutt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
ggaugcugaaguacagucctt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
ggacuguacuucagcaucctt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
auccuaguuccauucuuggtt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
ccaagaauggaacuaggautt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
uccuaguuccauucuuggutt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
accaagaauggaacuaggatt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
ggaguacaaucuggucuaatt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
uuagaccagauuguacucctt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
cacauuuccucucuaucuutt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
aagauagagaggaaaugugtt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
cacagaguuuguaguaaautt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
auuuacuacaaacucugugtt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
aacagacacuacauuaccctt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
ggguaauguagugucuguutt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
uucucagucaugcacucactt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
gugagugcaugacugagaatt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
gugccuccuagacacccgctt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
gcgggugucuaggaggcactt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
aagccaucaucagcuuaautt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
auuaagcugaugauggcuutt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
cucucuuucaauugcagautt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
aucugcaauugaaagagagtt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
acaccauccuccaguugaatt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
uucaacuggaggauggugutt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
uauccuaguuccauucuugtt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
caagaauggaacuaggauatt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
caaucuggucuaauugugctt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
gcacaauuagaccagauugtt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
ucaugcacucacaaagauatt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
uaucuuugugagugcaugatt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
agacacuacauuacccuaatt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
uuaggguaauguagugucutt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
acacaagagggacuguauutt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
aauacagucccucuugugutt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
gaugcugaaguacaguccctt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
gggacuguacuucagcauctt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
agccauagcuugauugcuctt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
gagcaaucaagcuauggcutt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
cacaggaguccuuucuuuutt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
aaaagaaaggacuccugugtt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
aucguucgauuuaagccautt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
auggcuuaaaucgaacgautt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
ucaucagcuuaauuuaagutt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
acuuaaauuaagcugaugatt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
agcacauuuccucucuauctt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
gauagagaggaaaugugcutt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
gugggcuauugaagauacatt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
uguaucuucaauagcccactt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
aucauguauucccaucuagtt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
cuagaugggaauacaugautt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
aaagacacacaggaguccutt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
aggacuccugugugucuuutt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
caaaugauacagucaggactt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
guccugacuguaucauuugtt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
uuagaacaauuaucacauatt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
uaugugauaauuguucuaatt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
uccauucuuggucaaguuutt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
aaacuugaccaagaauggatt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
cuggucuaauugugccucctt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
ggaggcacaauuagaccagtt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
cacaagagggacuguauuutt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
aaauacagucccucuugugtt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
ucuugucucacuuuggacutt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
aguccaaagugagacaagatt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
uuuucuauggagcaaaacatt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
uguuuugcuccauagaaaatt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
uuuagaacaauuaucacautt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
augugauaauuguucuaaatt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
ggaguccuuucuuuugaaatt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
uuucaaaagaaaggacucctt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
uuaagccaucaucagcuuatt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
uaagcugaugauggcuuaatt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
ucuaauugugccuccuagatt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
ucuaggaggcacaauuagatt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
aaguacagucccagcacautt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
augugcugggacuguacuutt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
cugaaguacagucccagcatt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
ugcugggacuguacuucagtt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
aauacuaauuuauugccgutt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
acggcaauaaauuaguauutt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
cagccauagcuugauugcutt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
agcaaucaagcuauggcugtt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
gucaggacacaucguucgatt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
ucgaacgauguguccugactt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
cuucccuggugggcuauugtt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
caauagcccaccagggaagtt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
gacacuacauuacccuaautt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
auuaggguaauguaguguctt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
acucugugugagcgugucctt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
ggacacgcucacacagagutt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
cccuggugggcuauugaagtt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
cuucaauagcccaccagggtt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
cucucaaaugauacagucatt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
ugacuguaucauuugagagtt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
aguacaaucuggucuaauutt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
aauuagaccagauuguacutt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
cacaaagauaagacuuguutt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
aacaagucuuaucuuugugtt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
acaaucuggucuaauugugtt

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
cacaauuagaccagauugutt

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
cagucaugcacucacaaagtt

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
cuuugugagugcaugacugtt

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
gacacaucguucgauuuaatt

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
uuaaaucgaacgauguguctt

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
cugcuacccagaaccuuuutt

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
aaaagguucuggguagcagtt

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
ucagccauagcuugauugctt

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
gcaaucaagcuauggcugatt

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
caauuugcauaauacuaautt

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
auuaguauuaugcaaauugtt

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
uaccuucagccauagcuugtt

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
caagcuauggcugaagguatt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
acagacacuacauuacccutt

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
aggguaauguagugucugutt

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
auacuaauuuauugccguctt

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
gacggcaauaaauuaguautt

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
gggcuauugaagauacacatt

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
uguguaucuucaauagccctt

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
guucgauuuaagccaucautt

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
augauggcuuaaaucgaactt

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
ugugccuccuagacacccgtt

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
cgggugucuaggaggcacatt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
cuggacucugugugagcgutt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
acgcucacacagaguccagtt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
acccucucuuucaauugcatt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
ugcaauugaaagagagggutt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
cagacacuacauuacccuatt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
uaggguaauguagugucugtt

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
aauuuauugccguccuggatt

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
uccaggacggcaauaaauutt

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
ugugugagcguguccacagtt

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
cuguggacacgcucacacatt

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
ccuggugggcuauugaagatt

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
ucuucaauagcccaccaggtt

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
accuucagccauagcuugatt

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
ucaagcuauggcugaaggutt

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
ggaugcugaaguacagucctt

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
ggacuguacuucagcaucctt

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
auccuaguuccauucuuggtt

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
ccaagaauggaacuaggautt

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
uccuaguuccauucuuggutt

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
accaagaauggaacuaggatt

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
ggaguacaaucuggucuaatt

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
uuagaccagauuguacucctt

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
cacauuuccucucuaucuutt

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
aagauagagaggaaaugugtt

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
cacagaguuuguaguaaautt

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
auuuacuacaaacucugugtt

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
aacagacacuacauuaccctt

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
ggguaauguagugucuguutt

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
uucucagucaugcacucactt

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
gugagugcaugacugagaatt

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
gugccuccuagacacccgctt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
gcgggugucuaggaggcactt

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
aagccaucaucagcuuaautt

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
auuaagcugaugauggcuutt

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
cucucuuucaauugcagautt

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
aucugcaauugaaagagagtt

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
acaccauccuccaguugaatt

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
uucaacuggaggauggugutt

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
uauccuaguuccauucuugtt

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
caagaauggaacuaggauatt

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
caaucuggucuaauugugctt

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
gcacaauuagaccagauugtt

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
ucaugcacucacaaagauatt

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
uaucuuugugagugcaugatt

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
agacacuacauuacccuaatt

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
uuaggguaauguagugucutt

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
acacaagagggacuguauutt

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
aauacagucccucuugugutt

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
gaugcugaaguacaguccctt

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
gggacuguacuucagcauctt

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
agccauagcuugauugcuctt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
gagcaaucaagcuauggcutt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
cacaggaguccuuucuuuutt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
aaaagaaaggacuccugugtt

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
aucguucgauuuaagccautt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
auggcuuaaaucgaacgautt

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
ucaucagcuuaauuuaagutt

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
acuuaaauuaagcugaugatt

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
agcacauuuccucucuauctt

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
gauagagaggaaaugugcutt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
gugggcuauugaagauacatt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
uguaucuucaauagcccactt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
aucauguauucccaucuagtt

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
cuagaugggaauacaugautt

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
aaagacacacaggaguccutt

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
aggacuccugugugucuuutt

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
caaaugauacagucaggactt

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
guccugacuguaucauuugtt

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
uuagaacaauuaucacauatt

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
uaugugauaauuguucuaatt

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
uccauucuuggucaaguuutt

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
aaacuugaccaagaauggatt

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
cuggucuaauugugccucctt

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
ggaggcacaauuagaccagtt

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
cacaagagggacuguauuutt

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
aaauacagucccucuugugtt

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
ucuugucucacuuuggacutt

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
aguccaaagugagacaagatt

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
uuuucuauggagcaaaacatt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
uguuuugcuccauagaaaatt

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
uuuagaacaauuaucacautt

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
augugauaauuguucuaaatt

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
ggaguccuuucuuuugaaatt

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
uuucaaaagaaaggacucctt

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
uuaagccaucaucagcuuatt

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
uaagcugaugauggcuuaatt

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
ucuaauugugccuccuagatt

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
ucuaggaggcacaauuagatt

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
aaguacagucccagcacautt

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
augugcugggacuguacuutt

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
cugaaguacagucccagcatt

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
ugcugggacuguacuucagtt

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
aauacuaauuuauugccgutt

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
acggcaauaaauuaguauutt

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
cagccauagcuugauugcutt

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
agcaaucaagcuauggcugtt

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
gucaggacacaucguucgatt

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
ucgaacgauguguccugactt

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
cuucccuggugggcuauugtt

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
caauagcccaccagggaagtt

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
gacacuacauuacccuaautt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
auuaggguaauguaguguctt

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
acucugugugagcgugucctt

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
ggacacgcucacacagagutt

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
cccuggugggcuauugaagtt

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
cuucaauagcccaccagggtt

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
cucucaaaugauacagucatt

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
ugacuguaucauuugagagtt

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
aguacaaucuggucuaauutt

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
aauuagaccagauuguacutt

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
cacaaagauaagacuuguutt

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
aacaagucuuaucuuugugtt

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
acaaucuggucuaauugugtt

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
cacaauuagaccagauugutt

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
cagucaugcacucacaaagtt

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
cuuugugagugcaugacugtt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
gacacaucguucgauuuaatt

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
uuaaaucgaacgauguguctt

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
cugcuacccagaaccuuuutt

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
aaaagguucuggguagcagtt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
ucagccauagcuugauugctt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
gcaaucaagcuauggcugatt

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
caauuugcauaauacuaautt

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
auuaguauuaugcaaauugtt

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
uaccuucagccauagcuugtt

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
caagcuauggcugaagguatt

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
acagacacuacauuacccutt

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
aggguaauguagugucugutt

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
auacuaauuuauugccguctt

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
gacggcaauaaauuaguautt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
gggcuauugaagauacacatt

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
uguguaucuucaauagccctt

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
guucgauuuaagccaucautt

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
augauggcuuaaaucgaactt

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
ugugccuccuagacacccgtt

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
cgggugucuaggaggcacatt

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
cuggacucugugugagcgutt

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
acgcucacacagaguccagtt

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
acccucucuuucaauugcatt

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
ugcaauugaaagagagggutt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
cagacacuacauuacccuatt

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
uaggguaauguagugucugtt

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
aauuuauugccguccuggatt

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
uccaggacggcaauaaauutt

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
ugugugagcguguccacagtt

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
cuguggacacgcucacacatt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
ccuggugggcuauugaagatt

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
ucuucaauagcccaccaggtt

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
accuucagccauagcuugatt

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
ucaagcuauggcugaaggutt

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
ggaugcugaaguacagucctt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
ggacuguacuucagcaucctt

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
auccuaguuccauucuuggtt

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
ccaagaauggaacuaggautt

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
uccuaguuccauucuuggutt

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
accaagaauggaacuaggatt

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
ggaguacaaucuggucuaatt

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
uuagaccagauuguacucctt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
cacauuuccucucuaucuutt

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
aagauagagaggaaaugugtt

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
cacagaguuuguaguaaautt

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
auuuacuacaaacucugugtt

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
aacagacacuacauuaccctt

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
ggguaauguagugucuguutt

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
uucucagucaugcacucactt

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
gugagugcaugacugagaatt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
gugccuccuagacacccgctt

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
gcgggugucuaggaggcactt

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
aagccaucaucagcuuaautt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
auuaagcugaugauggcuutt

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
cucucuuucaauugcagautt

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
aucugcaauugaaagagagtt

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
acaccauccuccaguugaatt

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
uucaacuggaggauggugutt

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
uauccuaguuccauucuugtt

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
caagaauggaacuaggauatt

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
caaucuggucuaauugugctt

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
gcacaauuagaccagauugtt

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
ucaugcacucacaaagauatt

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
uaucuuugugagugcaugatt

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
agacacuacauuacccuaatt

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
uuaggguaauguagugucutt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
acacaagagggacuguauutt

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
aauacagucccucuugugutt

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
gaugcugaaguacaguccctt

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
gggacuguacuucagcauctt

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
agccauagcuugauugcuctt

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
gagcaaucaagcuauggcutt

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
cacaggaguccuuucuuuutt

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
aaaagaaaggacuccugugtt

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
aucguucgauuuaagccautt

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
auggcuuaaaucgaacgautt

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
ucaucagcuuaauuuaagutt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
acuuaaauuaagcugaugatt

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
agcacauuuccucucuauctt

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
gauagagaggaaaugugcutt

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
gugggcuauugaagauacatt

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
uguaucuucaauagcccactt

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
aucauguauucccaucuagtt

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
cuagaugggaauacaugautt

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
aaagacacacaggaguccutt

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
aggacuccugugugucuuutt

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
caaaugauacagucaggactt

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
guccugacuguaucauuugtt

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
uuagaacaauuaucacauatt

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
uaugugauaauuguucuaatt

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
uccauucuuggucaaguuutt

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
aaacuugaccaagaauggatt

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
cuggucuaauugugccucctt

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
ggaggcacaauuagaccagtt

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
cacaagagggacuguauuutt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
aaauacagucccucuugugtt

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
ucuugucucacuuuggacutt

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
aguccaaagugagacaagatt

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
uuuucuauggagcaaaacatt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
uguuuugcuccauagaaaatt

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
uuuagaacaauuaucacautt

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
augugauaauuguucuaaatt

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
ggaguccuuucuuuugaaatt

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
uuucaaaagaaaggacucctt

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
uuaagccaucaucagcuuatt

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
uaagcugaugauggcuuaatt

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
ucuaauugugccuccuagatt

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
ucuaggaggcacaauuagatt

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
aaguacagucccagcacautt

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
augugcugggacuguacuutt

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
cugaaguacagucccagcatt

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
ugcugggacuguacuucagtt

SEQ ID NO: 877 - RNA, 19 nt, Artificial Sequence
  Description of Artificial Sequence: Synthetic oligonucleotide
uacuaauuuauugccgucc

SEQ ID NO: 878 - RNA, 19 nt, Artificial Sequence
  Description of Artificial Sequence: Synthetic oligonucleotide
cuaauuuauugccguccug

SEQ ID NO: 879 - RNA, 19 nt, Artificial Sequence
  Description of Artificial Sequence: Synthetic oligonucleotide
acuaauuuauugccguccu

SEQ ID NO: 880 - RNA, 19 nt, Artificial Sequence
  Description of Artificial Sequence: Synthetic oligonucleotide
guacagucccagcacauuu

SEQ ID NO: 881 - RNA, 19 nt, Artificial Sequence
  Description of Artificial Sequence: Synthetic oligonucleotide
auuuauugccguccuggac

SEQ ID NO: 882 - RNA, 19 nt, Artificial Sequence
  Description of Artificial Sequence: Synthetic oligonucleotide
guaguaaauauuaugauuu

SEQ ID NO: 883 - RNA, 19 nt, Artificial Sequence
  Description of Artificial Sequence: Synthetic oligonucleotide
uaauuuauugccguccugg

SEQ ID NO: 884 - RNA, 19 nt, Artificial Sequence
  Description of Artificial Sequence: Synthetic oligonucleotide
acaagagggacuguauuuc

SEQ ID NO: 885 - RNA, 19 nt, Artificial Sequence
  Description of Artificial Sequence: Synthetic oligonucleotide
uauugccguccuggacucu

SEQ ID NO: 886 - RNA, 19 nt, Artificial Sequence
  Description of Artificial Sequence: Synthetic oligonucleotide
gaaguacagucccagcaca

SEQ ID NO: 887 - RNA, 19 nt, Artificial Sequence
  Description of Artificial Sequence: Synthetic oligonucleotide
auuuaaacuauucagagga

SEQ ID NO: 888 - RNA, 19 nt, Artificial Sequence
  Description of Artificial Sequence: Synthetic oligonucleotide
ggacggcaauaaauuagua

SEQ ID NO: 889 - RNA, 19 nt, Artificial Sequence
  Description of Artificial Sequence: Synthetic oligonucleotide
caggacggcaauaaauuag

SEQ ID NO: 890 - RNA, 19 nt, Artificial Sequence
  Description of Artificial Sequence: Synthetic oligonucleotide
aggacggcaauaaauuagu

SEQ ID NO: 891 - RNA, 19 nt, Artificial Sequence
  Description of Artificial Sequence: Synthetic oligonucleotide
aaaugugcugggacuguac

SEQ ID NO: 892 - RNA, 19 nt, Artificial Sequence
  Description of Artificial Sequence: Synthetic oligonucleotide
guccaggacggcaauaaau

SEQ ID NO: 893 - RNA, 19 nt, Artificial Sequence
  Description of Artificial Sequence: Synthetic oligonucleotide
aaaucauaauauuuacuac

SEQ ID NO: 894 - RNA, 19 nt, Artificial Sequence
  Description of Artificial Sequence: Synthetic oligonucleotide
ccaggacggcaauaaauua

SEQ ID NO: 895 - RNA, 19 nt, Artificial Sequence
  Description of Artificial Sequence: Synthetic oligonucleotide
gaaauacagucccucuugu

SEQ ID NO: 896 - RNA, 19 nt, Artificial Sequence
  Description of Artificial Sequence: Synthetic oligonucleotide
agaguccaggacggcaaua

SEQ ID NO: 897 - RNA, 19 nt, Artificial Sequence
  Description of Artificial Sequence: Synthetic oligonucleotide
ugugcugggacuguacuuc

SEQ ID NO: 898 - RNA, 19 nt, Artificial Sequence
  Description of Artificial Sequence: Synthetic oligonucleotide
uccucugaauaguuuaaau

SEQ ID NO: 899 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uacuaauuuauugccguccnn

SEQ ID NO: 900 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggacggcaauaaauuaguann

SEQ ID NO: 901 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuaauuuauugccguccugnn

SEQ ID NO: 902 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caggacggcaauaaauuagnn

SEQ ID NO: 903 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acuaauuuauugccguccunn

SEQ ID NO: 904 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aggacggcaauaaauuagunn

SEQ ID NO: 905 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guacagucccagcacauuunn

SEQ ID NO: 906 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaaugugcugggacuguacnn

SEQ ID NO: 907 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuuauugccguccuggacnn

SEQ ID NO: 908 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guccaggacggcaauaaaunn

SEQ ID NO: 909 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guaguaaauauuaugauuunn

SEQ ID NO: 910 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aaaucauaauauuuacuacnn

SEQ ID NO: 911 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaauuuauugccguccuggnn

SEQ ID NO: 912 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ccaggacggcaauaaauuann

SEQ ID NO: 913 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acaagagggacuguauuucnn

SEQ ID NO: 914 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gaaauacagucccucuugunn

SEQ ID NO: 915 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uauugccguccuggacucunn

SEQ ID NO: 916 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agaguccaggacggcaauann

SEQ ID NO: 917 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gaaguacagucccagcacann

SEQ ID NO: 918 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugugcugggacuguacuucnn

SEQ ID NO: 919 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
auuuaaacuauucagaggann

SEQ ID NO: 920 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uccucugaauaguuuaaaunn

SEQ ID NO: 921 - DNA, 21 bp, Artificial Sequence
  Description of Artificial Sequence: Synthetic oligonucleotide
  Description of Combined DNA/RNA Molecule: Synthetic oligonucleotide
uacuaauuuauugccgucctt

SEQ ID NO: 922 - DNA, 21 bp, Artificial Sequence
  Description of Artificial Sequence: Synthetic oligonucleotide
  Description of Combined DNA/RNA Molecule: Synthetic oligonucleotide
ggacggcaauaaauuaguatt

SEQ ID NO: 923 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 924 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 925 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 926 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 927 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 928 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 929 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 930 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
guaguaaauauuaugauuutt

SEQ ID NO: 932 - DNA, 21 bp, Artificial Sequence
  Description of Artificial Sequence: Synthetic oligonucleotide
  Description of Combined DNA/RNA Molecule: Synthetic oligonucleotide
aaaucauaauauuuacuactt

SEQ ID NO: 933 - DNA, 21 bp, Artificial Sequence
  Description of Artificial Sequence: Synthetic oligonucleotide
  Description of Combined DNA/RNA Molecule: Synthetic oligonucleotide
uaauuuauugccguccuggtt

SEQ ID NO: 934 - DNA, 21 bp, Artificial Sequence
  Description of Artificial Sequence: Synthetic oligonucleotide
  Description of Combined DNA/RNA Molecule: Synthetic oligonucleotide
ccaggacggcaauaaauuatt

SEQ ID NO: 935 - DNA, 21 bp, Artificial Sequence
  Description of Artificial Sequence: Synthetic oligonucleotide
  Description of Combined DNA/RNA Molecule: Synthetic oligonucleotide
acaagagggacuguauuuctt

SEQ ID NO: 936 - DNA, 21 bp, Artificial Sequence
  Description of Artificial Sequence: Synthetic oligonucleotide
  Description of Combined DNA/RNA Molecule: Synthetic oligonucleotide
gaaauacagucccucuugutt

SEQ ID NO: 937 - DNA, 21 bp, Artificial Sequence
  Description of Artificial Sequence: Synthetic oligonucleotide
  Description of Combined DNA/RNA Molecule: Synthetic oligonucleotide
uauugccguccuggacucutt

SEQ ID NO: 938 - DNA, 21 bp, Artificial Sequence
  Description of Artificial Sequence: Synthetic oligonucleotide
  Description of Combined DNA/RNA Molecule: Synthetic oligonucleotide
agaguccaggacggcaauatt

SEQ ID NO: 939 - DNA, 21 bp, Artificial Sequence
  Description of Artificial Sequence: Synthetic oligonucleotide
  Description of Combined DNA/RNA Molecule: Synthetic oligonucleotide
gaaguacagucccagcacatt

SEQ ID NO: 940 - DNA, 21 bp, Artificial Sequence
  Description of Artificial Sequence: Synthetic oligonucleotide
  Description of Combined DNA/RNA Molecule: Synthetic oligonucleotide
ugugcugggacuguacuuctt

SEQ ID NO: 941 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 942 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 943 - DNA, 21 bp, Artificial Sequence
  Description of Artificial Sequence: Synthetic oligonucleotide
  Description of Combined DNA/RNA Molecule: Synthetic oligonucleotide
uacuaauuuauugccgucctt

SEQ ID NO: 944 - DNA, 21 bp, Artificial Sequence
  Description of Artificial Sequence: Synthetic oligonucleotide
  Description of Combined DNA/RNA Molecule: Synthetic oligonucleotide
ggacggcaauaaauuaguatt

SEQ ID NO: 945 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 946 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 947 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 948 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 949 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 950 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 951 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 952 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 953 - DNA, 21 bp, Artificial Sequence
  Description of Artificial Sequence: Synthetic oligonucleotide
  Description of Combined DNA/RNA Molecule: Synthetic oligonucleotide
guaguaaauauuaugauuutt

SEQ ID NO: 954 - DNA, 21 bp, Artificial Sequence
  Description of Artificial Sequence: Synthetic oligonucleotide
  Description of Combined DNA/RNA Molecule: Synthetic oligonucleotide
aaaucauaauauuuacuactt

SEQ ID NO: 955 - DNA, 21 bp, Artificial Sequence
  Description of Artificial Sequence: Synthetic oligonucleotide
  Description of Combined DNA/RNA Molecule: Synthetic oligonucleotide
uaauuuauugccguccuggtt

SEQ ID NO: 956 - DNA, 21 bp, Artificial Sequence
  Description of Artificial Sequence: Synthetic oligonucleotide
  Description of Combined DNA/RNA Molecule: Synthetic oligonucleotide
ccaggacggcaauaaauuatt

SEQ ID NO: 957 - DNA, 21 bp, Artificial Sequence
  Description of Artificial Sequence: Synthetic oligonucleotide
  Description of Combined DNA/RNA Molecule: Synthetic oligonucleotide
acaagagggacuguauuuctt

SEQ ID NO: 958 - DNA, 21 bp, Artificial Sequence
  Description of Artificial Sequence: Synthetic oligonucleotide
  Description of Combined DNA/RNA Molecule: Synthetic oligonucleotide
gaaauacagucccucuugutt

SEQ ID NO: 959 - DNA, 21 bp, Artificial Sequence
  Description of Artificial Sequence: Synthetic oligonucleotide
  Description of Combined DNA/RNA Molecule: Synthetic oligonucleotide
uauugccguccuggacucutt

SEQ ID NO: 960 - DNA, 21 bp, Artificial Sequence
  Description of Artificial Sequence: Synthetic oligonucleotide
  Description of Combined DNA/RNA Molecule: Synthetic oligonucleotide
agaguccaggacggcaauatt

SEQ ID NO: 961 - DNA, 21 bp, Artificial Sequence
  Description of Artificial Sequence: Synthetic oligonucleotide
  Description of Combined DNA/RNA Molecule: Synthetic oligonucleotide
gaaguacagucccagcacatt

SEQ ID NO: 962 - DNA, 21 bp, Artificial Sequence
  Description of Artificial Sequence: Synthetic oligonucleotide
  Description of Combined DNA/RNA Molecule: Synthetic oligonucleotide
ugugcugggacuguacuuctt

SEQ ID NO: 963 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 964 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 965 - DNA, 21 bp, Artificial Sequence
  Description of Artificial Sequence: Synthetic oligonucleotide
  Description of Combined DNA/RNA Molecule: Synthetic oligonucleotide
uacuaauuuauugccgucctt

SEQ ID NO: 966 - DNA, 21 bp, Artificial Sequence
  Description of Artificial Sequence: Synthetic oligonucleotide
  Description of Combined DNA/RNA Molecule: Synthetic oligonucleotide
ggacggcaauaaauuaguatt

SEQ ID NO: 967 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 968 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 969 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 970 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 971 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 972 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 973 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
guaguaaauauuaugauuutt

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
aaaucauaauauuuacuactt

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
uaauuuauugccguccuggtt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
ccaggacggcaauaaauuatt

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
acaagagggacuguauuuctt

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
gaaauacagucccucuugutt

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
uauugccguccuggacucutt

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
agaguccaggacggcaauatt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
gaaguacagucccagcacatt

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
ugugcugggacuguacuuctt

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
uacuaauuuauugccgucctt

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
ggacggcaauaaauuaguatt

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
guaguaaauauuaugauuutt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
aaaucauaauauuuacuactt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
uaauuuauugccguccuggtt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
ccaggacggcaauaaauuatt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
acaagagggacuguauuuctt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
gaaauacagucccucuugutt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
uauugccguccuggacucutt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
agaguccaggacggcaauatt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
gaaguacagucccagcacatt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
ugugcugggacuguacuuctt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 1009 - RNA, 19 nt, Artificial Sequence
  Description of Artificial Sequence: Synthetic oligonucleotide
uauucccaccuagucgacu

SEQ ID NO: 1010 - RNA, 19 nt, Artificial Sequence
  Description of Artificial Sequence: Synthetic oligonucleotide
uucccaccuagucgacuac

SEQ ID NO: 1011 - RNA, 19 nt, Artificial Sequence
  Description of Artificial Sequence: Synthetic oligonucleotide
gcuuuugagaauccauaug

SEQ ID NO: 1012 - RNA, 19 nt, Artificial Sequence
  Description of Artificial Sequence: Synthetic oligonucleotide
cggaggaucaacgacgaga

SEQ ID NO: 1013 - RNA, 19 nt, Artificial Sequence
  Description of Artificial Sequence: Synthetic oligonucleotide
aucugacucuaccaaauac

SEQ ID NO: 1014 - RNA, 19 nt, Artificial Sequence
  Description of Artificial Sequence: Synthetic oligonucleotide
acacaauaaggcucaugca

SEQ ID NO: 1015 - RNA, 19 nt, Artificial Sequence
  Description of Artificial Sequence: Synthetic oligonucleotide
aggaucauccacgggucgg

SEQ ID NO: 1016 - RNA, 19 nt, Artificial Sequence
  Description of Artificial Sequence: Synthetic oligonucleotide
cccauacaaguaugaacac

SEQ ID NO: 1017 - RNA, 19 nt, Artificial Sequence
  Description of Artificial Sequence: Synthetic oligonucleotide
caauaaggcucaugcacaa

SEQ ID NO: 1018 - RNA, 19 nt, Artificial Sequence
  Description of Artificial Sequence: Synthetic oligonucleotide
aggaucaacgacgagaucg

SEQ ID NO: 1019 - RNA, 19 nt, Artificial Sequence
  Description of Artificial Sequence: Synthetic oligonucleotide
ucaugcacaauugguucga

SEQ ID NO: 1020 - RNA, 19 nt, Artificial Sequence
  Description of Artificial Sequence: Synthetic oligonucleotide
ggaucaacgacgagaucga

SEQ ID NO: 1021 - RNA, 19 nt, Artificial Sequence
  Description of Artificial Sequence: Synthetic oligonucleotide
agagcuuguggaaugaucc

SEQ ID NO: 1022 - RNA, 19 nt, Artificial Sequence
  Description of Artificial Sequence: Synthetic oligonucleotide
gaggaucaacgacgagauc

SEQ ID NO: 1023 - RNA, 19 nt, Artificial Sequence
  Description of Artificial Sequence: Synthetic oligonucleotide
ggaggaucaacgacgagau

SEQ ID NO: 1024 - RNA, 19 nt, Artificial Sequence
  Description of Artificial Sequence: Synthetic oligonucleotide
uuuugagaauccauaugua

SEQ ID NO: 1025 - RNA, 19 nt, Artificial Sequence
  Description of Artificial Sequence: Synthetic oligonucleotide
caaggaagcccggaggauc

SEQ ID NO: 1026 - RNA, 19 nt, Artificial Sequence
  Description of Artificial Sequence: Synthetic oligonucleotide
ucugacucuaccaaauacu

SEQ ID NO: 1027 - RNA, 19 nt, Artificial Sequence
  Description of Artificial Sequence: Synthetic oligonucleotide
aagcgcgacgcccgccggg

SEQ ID NO: 1028 - RNA, 19 nt, Artificial Sequence
  Description of Artificial Sequence: Synthetic oligonucleotide
acaauaaggcucaugcaca

SEQ ID NO: 1029 - RNA, 19 nt, Artificial Sequence
  Description of Artificial Sequence: Synthetic oligonucleotide
uaaggcucaugcacaauug

SEQ ID NO: 1030 - RNA, 19 nt, Artificial Sequence
  Description of Artificial Sequence: Synthetic oligonucleotide
aagcccggaggaucaacga

SEQ ID NO: 1031 - RNA, 19 nt, Artificial Sequence
  Description of Artificial Sequence: Synthetic oligonucleotide
cucaugcacaauugguucg

SEQ ID NO: 1032 - RNA, 19 nt, Artificial Sequence
  Description of Artificial Sequence: Synthetic oligonucleotide
ugcacaauugguucgagag

SEQ ID NO: 1033 - RNA, 19 nt, Artificial Sequence
  Description of Artificial Sequence: Synthetic oligonucleotide
cacaauugguucgagaggu

SEQ ID NO: 1034 - RNA, 19 nt, Artificial Sequence
  Description of Artificial Sequence: Synthetic oligonucleotide
cuagucgacuacuucccag

SEQ ID NO: 1035 - RNA, 19 nt, Artificial Sequence
  Description of Artificial Sequence: Synthetic oligonucleotide
gcagggacaagcgcgacgc

SEQ ID NO: 1036 - RNA, 19 nt, Artificial Sequence
  Description of Artificial Sequence: Synthetic oligonucleotide
uugagaauccauauguaga

SEQ ID NO: 1037 - RNA, 19 nt, Artificial Sequence
  Description of Artificial Sequence: Synthetic oligonucleotide
gacuacuucccagaauaug

SEQ ID NO: 1038 - RNA, 19 nt, Artificial Sequence
  Description of Artificial Sequence: Synthetic oligonucleotide
ucaacgacgagaucgagcg

SEQ ID NO: 1039 - RNA, 19 nt, Artificial Sequence
  Description of Artificial Sequence: Synthetic oligonucleotide
agucgacuaggugggaaua

SEQ ID NO: 1040 - RNA, 19 nt, Artificial Sequence
  Description of Artificial Sequence: Synthetic oligonucleotide
guagucgacuaggugggaa

SEQ ID NO: 1041 - RNA, 19 nt, Artificial Sequence
  Description of Artificial Sequence: Synthetic oligonucleotide
cauauggauucucaaaagc

SEQ ID NO: 1042 - RNA, 19 nt, Artificial Sequence
  Description of Artificial Sequence: Synthetic oligonucleotide
ucucgucguugauccuccg

SEQ ID NO: 1043 - RNA, 19 nt, Artificial Sequence
  Description of Artificial Sequence: Synthetic oligonucleotide
guauuugguagagucagau

SEQ ID NO: 1044 - RNA, 19 nt, Artificial Sequence
  Description of Artificial Sequence: Synthetic oligonucleotide
ugcaugagccuuauugugu

SEQ ID NO: 1045 - RNA, 19 nt, Artificial Sequence
  Description of Artificial Sequence: Synthetic oligonucleotide
ccgacccguggaugauccu

SEQ ID NO: 1046 - RNA, 19 nt, Artificial Sequence
  Description of Artificial Sequence: Synthetic oligonucleotide
guguucauacuuguauggg

SEQ ID NO: 1047 - RNA, 19 nt, Artificial Sequence
  Description of Artificial Sequence: Synthetic oligonucleotide
uugugcaugagccuuauug

SEQ ID NO: 1048 - RNA, 19 nt, Artificial Sequence
  Description of Artificial Sequence: Synthetic oligonucleotide
cgaucucgucguugauccu

SEQ ID NO: 1049 - RNA, 19 nt, Artificial Sequence
  Description of Artificial Sequence: Synthetic oligonucleotide
ucgaaccaauugugcauga

SEQ ID NO: 1050 - RNA, 19 nt, Artificial Sequence
  Description of Artificial Sequence: Synthetic oligonucleotide
ucgaucucgucguugaucc

SEQ ID NO: 1051 - RNA, 19 nt, Artificial Sequence
  Description of Artificial Sequence: Synthetic oligonucleotide
ggaucauuccacaagcucu

SEQ ID NO: 1052 - RNA, 19 nt, Artificial Sequence
  Description of Artificial Sequence: Synthetic oligonucleotide
gaucucgucguugauccuc

SEQ ID NO: 1053 - RNA, 19 nt, Artificial Sequence
  Description of Artificial Sequence: Synthetic oligonucleotide
aucucgucguugauccucc

SEQ ID NO: 1054 - RNA, 19 nt, Artificial Sequence
  Description of Artificial Sequence: Synthetic oligonucleotide
uacauauggauucucaaaa

SEQ ID NO: 1055 - RNA, 19 nt, Artificial Sequence
  Description of Artificial Sequence: Synthetic oligonucleotide
gauccuccgggcuuccuug

SEQ ID NO: 1056 - RNA, 19 nt, Artificial Sequence
  Description of Artificial Sequence: Synthetic oligonucleotide
aguauuugguagagucaga

SEQ ID NO: 1057 - RNA, 19 nt, Artificial Sequence
  Description of Artificial Sequence: Synthetic oligonucleotide
cccggcgggcgucgcgcuu

SEQ ID NO: 1058 - RNA, 19 nt, Artificial Sequence
  Description of Artificial Sequence: Synthetic oligonucleotide
ugugcaugagccuuauugu

SEQ ID NO: 1059 - RNA, 19 nt, Artificial Sequence
  Description of Artificial Sequence: Synthetic oligonucleotide
caauugugcaugagccuua

SEQ ID NO: 1060 - RNA, 19 nt, Artificial Sequence
  Description of Artificial Sequence: Synthetic oligonucleotide
ucguugauccuccgggcuu

SEQ ID NO: 1061 - RNA, 19 nt, Artificial Sequence
  Description of Artificial Sequence: Synthetic oligonucleotide
cgaaccaauugugcaugag

SEQ ID NO: 1062 - RNA, 19 nt, Artificial Sequence
  Description of Artificial Sequence: Synthetic oligonucleotide
cucucgaaccaauugugca

SEQ ID NO: 1063 - RNA, 19 nt, Artificial Sequence
  Description of Artificial Sequence: Synthetic oligonucleotide
accucucgaaccaauugug

SEQ ID NO: 1064 - RNA, 19 nt, Artificial Sequence
  Description of Artificial Sequence: Synthetic oligonucleotide
cugggaaguagucgacuag

SEQ ID NO: 1065 - RNA, 19 nt, Artificial Sequence
  Description of Artificial Sequence: Synthetic oligonucleotide
gcgucgcgcuugucccugc

SEQ ID NO: 1066 - RNA, 19 nt, Artificial Sequence
  Description of Artificial Sequence: Synthetic oligonucleotide
ucuacauauggauucucaa

SEQ ID NO: 1067 - RNA, 19 nt, Artificial Sequence
  Description of Artificial Sequence: Synthetic oligonucleotide
cauauucugggaaguaguc

SEQ ID NO: 1068 - RNA, 19 nt, Artificial Sequence
  Description of Artificial Sequence: Synthetic oligonucleotide
cgcucgaucucgucguuga

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uauucccaccuagucgacunn

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agucgacuaggugggaauann

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uucccaccuagucgacuacnn

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guagucgacuaggugggaann

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gcuuuugagaauccauaugnn

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cauauggauucucaaaagcnn

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cggaggaucaacgacgagann

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucucgucguugauccuccgnn

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aucugacucuaccaaauacnn

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guauuugguagagucagaunn

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acacaauaaggcucaugcann

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugcaugagccuuauugugunn

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aggaucauccacgggucggnn

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ccgacccguggaugauccunn

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cccauacaaguaugaacacnn

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
guguucauacuuguaugggnn

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caauaaggcucaugcacaann

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uugugcaugagccuuauugnn

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aggaucaacgacgagaucgnn

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cgaucucgucguugauccunn

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucaugcacaauugguucgann

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucgaaccaauugugcaugann

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaucaacgacgagaucgann

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucgaucucgucguugauccnn

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
agagcuuguggaaugauccnn

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaucauuccacaagcucunn

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gaggaucaacgacgagaucnn

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gaucucgucguugauccucnn

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ggaggaucaacgacgagaunn

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aucucgucguugauccuccnn

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uuuugagaauccauauguann

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uacauauggauucucaaaann

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caaggaagcccggaggaucnn

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gauccuccgggcuuccuugnn

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucugacucuaccaaauacunn

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aguauuugguagagucagann

SEQ ID NO: 1105 - DNA, 21 bp, Artificial Sequence
  Description of Artificial Sequence: Synthetic oligonucleotide
  modified_base (20)..(21): g, a, c, u or t
aagcgcgacgcccgccgggnn

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cccggcgggcgucgcgcuunn

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
acaauaaggcucaugcacann

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugugcaugagccuuauugunn

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uaaggcucaugcacaauugnn

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
caauugugcaugagccuuann

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
aagcccggaggaucaacgann

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucguugauccuccgggcuunn

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cucaugcacaauugguucgnn

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cgaaccaauugugcaugagnn

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ugcacaauugguucgagagnn

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cucucgaaccaauugugcann

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cacaauugguucgagaggunn

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
accucucgaaccaauugugnn

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cuagucgacuacuucccagnn

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cugggaaguagucgacuagnn

SEQ ID NO: 1121 - DNA, 21 bp, Artificial Sequence
  Description of Artificial Sequence: Synthetic oligonucleotide
  modified_base (20)..(21): g, a, c, u or t
gcagggacaagcgcgacgcnn

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gcgucgcgcuugucccugcnn

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
uugagaauccauauguagann

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucuacauauggauucucaann

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
gacuacuucccagaauaugnn

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cauauucugggaaguagucnn

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
ucaacgacgagaucgagcgnn

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): g, a, c, u or t
cgcucgaucucgucguugann

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
uauucccaccuagucgacutt

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
agucgacuaggugggaauatt

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
uucccaccuagucgacuactt

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
guagucgacuaggugggaatt

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
gcuuuugagaauccauaugtt

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
cauauggauucucaaaagctt

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
cggaggaucaacgacgagatt

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
ucucgucguugauccuccgtt

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
aucugacucuaccaaauactt

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
guauuugguagagucagautt

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
acacaauaaggcucaugcatt

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
ugcaugagccuuauugugutt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
aggaucauccacgggucggtt

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
ccgacccguggaugauccutt

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
cccauacaaguaugaacactt

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
guguucauacuuguaugggtt

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
caauaaggcucaugcacaatt

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
uugugcaugagccuuauugtt

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
aggaucaacgacgagaucgtt

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
cgaucucgucguugauccutt

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
ucaugcacaauugguucgatt

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
ucgaaccaauugugcaugatt

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
ggaucaacgacgagaucgatt

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
ucgaucucgucguugaucctt

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
agagcuuguggaaugaucctt

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
ggaucauuccacaagcucutt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
gaggaucaacgacgagauctt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
gaucucgucguugauccuctt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
ggaggaucaacgacgagautt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
aucucgucguugauccucctt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
uuuugagaauccauauguatt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
uacauauggauucucaaaatt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
caaggaagcccggaggauctt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
gauccuccgggcuuccuugtt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
ucugacucuaccaaauacutt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
aguauuugguagagucagatt

SEQ ID NO: 1165 - DNA, 21 bp, Artificial Sequence
  Description of Artificial Sequence: Synthetic oligonucleotide
aagcgcgacgcccgccgggtt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
cccggcgggcgucgcgcuutt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
acaauaaggcucaugcacatt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
ugugcaugagccuuauugutt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
uaaggcucaugcacaauugtt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
caauugugcaugagccuuatt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
aagcccggaggaucaacgatt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
ucguugauccuccgggcuutt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
cucaugcacaauugguucgtt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
cgaaccaauugugcaugagtt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
ugcacaauugguucgagagtt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
cucucgaaccaauugugcatt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
cacaauugguucgagaggutt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
accucucgaaccaauugugtt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
cuagucgacuacuucccagtt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
cugggaaguagucgacuagtt

SEQ ID NO: 1181 - DNA, 21 bp, Artificial Sequence
  Description of Artificial Sequence: Synthetic oligonucleotide
gcagggacaagcgcgacgctt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
gcgucgcgcuugucccugctt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
uugagaauccauauguagatt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
ucuacauauggauucucaatt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
gacuacuucccagaauaugtt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
cauauucugggaaguaguctt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
ucaacgacgagaucgagcgtt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
cgcucgaucucgucguugatt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
uauucccaccuagucgacutt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
agucgacuaggugggaauatt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
uucccaccuagucgacuactt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
guagucgacuaggugggaatt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
gcuuuugagaauccauaugtt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
cauauggauucucaaaagctt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
cggaggaucaacgacgagatt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
ucucgucguugauccuccgtt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
aucugacucuaccaaauactt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
guauuugguagagucagautt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
acacaauaaggcucaugcatt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
ugcaugagccuuauugugutt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
aggaucauccacgggucggtt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
ccgacccguggaugauccutt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
cccauacaaguaugaacactt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
guguucauacuuguaugggtt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
caauaaggcucaugcacaatt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
uugugcaugagccuuauugtt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
aggaucaacgacgagaucgtt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
cgaucucgucguugauccutt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
ucaugcacaauugguucgatt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
ucgaaccaauugugcaugatt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
ggaucaacgacgagaucgatt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
ucgaucucgucguugaucctt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
agagcuuguggaaugaucctt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
ggaucauuccacaagcucutt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
gaggaucaacgacgagauctt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
gaucucgucguugauccuctt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
ggaggaucaacgacgagautt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
aucucgucguugauccucctt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
uuuugagaauccauauguatt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
uacauauggauucucaaaatt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
caaggaagcccggaggauctt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
gauccuccgggcuuccuugtt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
ucugacucuaccaaauacutt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
aguauuugguagagucagatt

SEQ ID NO: 1225 - DNA, 21 bp, Artificial Sequence
  Description of Artificial Sequence: Synthetic oligonucleotide
aagcgcgacgcccgccgggtt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
cccggcgggcgucgcgcuutt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
acaauaaggcucaugcacatt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
ugugcaugagccuuauugutt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
uaaggcucaugcacaauugtt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
caauugugcaugagccuuatt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
aagcccggaggaucaacgatt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
ucguugauccuccgggcuutt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
cucaugcacaauugguucgtt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
cgaaccaauugugcaugagtt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
ugcacaauugguucgagagtt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
cucucgaaccaauugugcatt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
cacaauugguucgagaggutt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
accucucgaaccaauugugtt

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
cuagucgacuacuucccagtt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
cugggaaguagucgacuagtt

SEQ ID NO: 1241 - DNA, 21 bp, Artificial Sequence
  Description of Artificial Sequence: Synthetic oligonucleotide
gcagggacaagcgcgacgctt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
gcgucgcgcuugucccugctt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
uugagaauccauauguagatt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
ucuacauauggauucucaatt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
gacuacuucccagaauaugtt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
cauauucugggaaguaguctt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
ucaacgacgagaucgagcgtt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
cgcucgaucucgucguugatt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
uauucccaccuagucgacutt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
agucgacuaggugggaauatt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
uucccaccuagucgacuactt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
guagucgacuaggugggaatt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
gcuuuugagaauccauaugtt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
cauauggauucucaaaagctt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
cggaggaucaacgacgagatt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
ucucgucguugauccuccgtt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
aucugacucuaccaaauactt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
guauuugguagagucagautt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
acacaauaaggcucaugcatt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
ugcaugagccuuauugugutt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
aggaucauccacgggucggtt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
ccgacccguggaugauccutt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
cccauacaaguaugaacactt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
guguucauacuuguaugggtt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
caauaaggcucaugcacaatt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
uugugcaugagccuuauugtt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
aggaucaacgacgagaucgtt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
cgaucucgucguugauccutt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ucaugcacaauugguucgatt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
ucgaaccaauugugcaugatt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
ggaucaacgacgagaucgatt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
ucgaucucgucguugaucctt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
agagcuuguggaaugaucctt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
ggaucauuccacaagcucutt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
gaggaucaacgacgagauctt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
gaucucgucguugauccuctt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
ggaggaucaacgacgagautt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
aucucgucguugauccucctt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
uuuugagaauccauauguatt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
uacauauggauucucaaaatt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
caaggaagcccggaggauctt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
gauccuccgggcuuccuugtt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
ucugacucuaccaaauacutt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
aguauuugguagagucagatt

SEQ ID NO: 1285 - DNA, 21 bp, Artificial Sequence
  Description of Artificial Sequence: Synthetic oligonucleotide
aagcgcgacgcccgccgggtt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
cccggcgggcgucgcgcuutt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
acaauaaggcucaugcacatt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
ugugcaugagccuuauugutt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
uaaggcucaugcacaauugtt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
caauugugcaugagccuuatt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
aagcccggaggaucaacgatt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
ucguugauccuccgggcuutt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
cucaugcacaauugguucgtt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
cgaaccaauugugcaugagtt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
ugcacaauugguucgagagtt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
cucucgaaccaauugugcatt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
cacaauugguucgagaggutt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
accucucgaaccaauugugtt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
cuagucgacuacuucccagtt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
cugggaaguagucgacuagtt

SEQ ID NO: 1301 - DNA, 21 bp, Artificial Sequence
  Description of Artificial Sequence: Synthetic oligonucleotide
gcagggacaagcgcgacgctt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
gcgucgcgcuugucccugctt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
uugagaauccauauguagatt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
ucuacauauggauucucaatt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
gacuacuucccagaauaugtt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
cauauucugggaaguaguctt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
ucaacgacgagaucgagcgtt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
cgcucgaucucgucguugatt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
uauucccaccuagucgacutt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
agucgacuaggugggaauatt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
uucccaccuagucgacuactt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
guagucgacuaggugggaatt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
gcuuuugagaauccauaugtt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
cauauggauucucaaaagctt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
cggaggaucaacgacgagatt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
ucucgucguugauccuccgtt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
aucugacucuaccaaauactt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
guauuugguagagucagautt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
acacaauaaggcucaugcatt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
ugcaugagccuuauugugutt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
aggaucauccacgggucggtt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
ccgacccguggaugauccutt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
cccauacaaguaugaacactt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
guguucauacuuguaugggtt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
caauaaggcucaugcacaatt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
uugugcaugagccuuauugtt

SEQ ID NO: 1327 - DNA, 21 bp, Artificial Sequence
  Description of Artificial Sequence: Synthetic oligonucleotide
  Description of Combined DNA/RNA Molecule: Synthetic oligonucleotide
aggaucaacgacgagaucgtt

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
cgaucucgucguugauccutt

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
ucaugcacaauugguucgatt

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
ucgaaccaauugugcaugatt

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
ggaucaacgacgagaucgatt

SEQ ID NO: 1332 - DNA, 21 bp, Artificial Sequence
  Description of Artificial Sequence: Synthetic oligonucleotide
  Description of Combined DNA/RNA Molecule: Synthetic oligonucleotide
ucgaucucgucguugaucctt

SEQ ID NO: 1333 - DNA, 21 bp, Artificial Sequence
  Description of Artificial Sequence: Synthetic oligonucleotide
  Description of Combined DNA/RNA Molecule: Synthetic oligonucleotide
agagcuuguggaaugaucctt

SEQ ID NO: 1334 - DNA, 21 bp, Artificial Sequence
  Description of Artificial Sequence: Synthetic oligonucleotide
  Description of Combined DNA/RNA Molecule: Synthetic oligonucleotide
ggaucauuccacaagcucutt

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
gaggaucaacgacgagauctt

SEQ ID NO: 1336 - DNA, 21 bp, Artificial Sequence
  Description of Artificial Sequence: Synthetic oligonucleotide
  Description of Combined DNA/RNA Molecule: Synthetic oligonucleotide
gaucucgucguugauccuctt

SEQ ID NO: 1337 - DNA, 21 bp, Artificial Sequence
  Description of Artificial Sequence: Synthetic oligonucleotide
  Description of Combined DNA/RNA Molecule: Synthetic oligonucleotide
ggaggaucaacgacgagautt

SEQ ID NO: 1338 - DNA, 21 bp, Artificial Sequence
  Description of Artificial Sequence: Synthetic oligonucleotide
  Description of Combined DNA/RNA Molecule: Synthetic oligonucleotide
aucucgucguugauccucctt

SEQ ID NO: 1339 - DNA, 21 bp, Artificial Sequence
  Description of Artificial Sequence: Synthetic oligonucleotide
  Description of Combined DNA/RNA Molecule: Synthetic oligonucleotide
uuuugagaauccauauguatt

SEQ ID NO: 1340 - DNA, 21 bp, Artificial Sequence
  Description of Artificial Sequence: Synthetic oligonucleotide
  Description of Combined DNA/RNA Molecule: Synthetic oligonucleotide
uacauauggauucucaaaatt

SEQ ID NO: 1341 - DNA, 21 bp, Artificial Sequence
  Description of Artificial Sequence: Synthetic oligonucleotide
  Description of Combined DNA/RNA Molecule: Synthetic oligonucleotide
caaggaagcccggaggauctt

SEQ ID NO: 1342 - DNA, 21 bp, Artificial Sequence
  Description of Artificial Sequence: Synthetic oligonucleotide
  Description of Combined DNA/RNA Molecule: Synthetic oligonucleotide
gauccuccgggcuuccuugtt

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
ucugacucuaccaaauacutt

SEQ ID NO: 1344 - DNA, 21 bp, Artificial Sequence
  Description of Artificial Sequence: Synthetic oligonucleotide
  Description of Combined DNA/RNA Molecule: Synthetic oligonucleotide
aguauuugguagagucagatt

SEQ ID NO: 1345 - DNA, 21 bp, Artificial Sequence
  Description of Artificial Sequence: Synthetic oligonucleotide
aagcgcgacgcccgccgggtt

SEQ ID NO: 1346 - DNA, 21 bp, Artificial Sequence
  Description of Artificial Sequence: Synthetic oligonucleotide
  Description of Combined DNA/RNA Molecule: Synthetic oligonucleotide
cccggcgggcgucgcgcuutt

SEQ ID NO: 1347 - DNA, 21 bp, Artificial Sequence
  Description of Artificial Sequence: Synthetic oligonucleotide
  Description of Combined DNA/RNA Molecule: Synthetic oligonucleotide
acaauaaggcucaugcacatt

SEQ ID NO: 1348 - DNA, 21 bp, Artificial Sequence
  Description of Artificial Sequence: Synthetic oligonucleotide
  Description of Combined DNA/RNA Molecule: Synthetic oligonucleotide
ugugcaugagccuuauugutt

SEQ ID NO: 1349 - DNA, 21 bp, Artificial Sequence
  Description of Artificial Sequence: Synthetic oligonucleotide
  Description of Combined DNA/RNA Molecule: Synthetic oligonucleotide
uaaggcucaugcacaauugtt

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
caauugugcaugagccuuatt

SEQ ID NO: 1351 - DNA, 21 bp, Artificial Sequence
  Description of Artificial Sequence: Synthetic oligonucleotide
  Description of Combined DNA/RNA Molecule: Synthetic oligonucleotide
aagcccggaggaucaacgatt

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
ucguugauccuccgggcuutt

SEQ ID NO: 1353 - DNA, 21 bp, Artificial Sequence
  Description of Artificial Sequence: Synthetic oligonucleotide
  Description of Combined DNA/RNA Molecule: Synthetic oligonucleotide
cucaugcacaauugguucgtt

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
cgaaccaauugugcaugagtt

SEQ ID NO: 1355 - DNA, 21 bp, Artificial Sequence
  Description of Artificial Sequence: Synthetic oligonucleotide
  Description of Combined DNA/RNA Molecule: Synthetic oligonucleotide
ugcacaauugguucgagagtt

SEQ ID NO: 1356 - DNA, 21 bp, Artificial Sequence
  Description of Artificial Sequence: Synthetic oligonucleotide
  Description of Combined DNA/RNA Molecule: Synthetic oligonucleotide
cucucgaaccaauugugcatt

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
cacaauugguucgagaggutt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
accucucgaaccaauugugtt

SEQ ID NO: 1359 - DNA, 21 bp, Artificial Sequence
  Description of Artificial Sequence: Synthetic oligonucleotide
  Description of Combined DNA/RNA Molecule: Synthetic oligonucleotide
cuagucgacuacuucccagtt

SEQ ID NO: 1360 - DNA, 21 bp, Artificial Sequence
  Description of Artificial Sequence: Synthetic oligonucleotide
  Description of Combined DNA/RNA Molecule: Synthetic oligonucleotide
cugggaaguagucgacuagtt

SEQ ID NO: 1361 - DNA, 21 bp, Artificial Sequence
  Description of Artificial Sequence: Synthetic oligonucleotide
gcagggacaagcgcgacgctt

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
gcgucgcgcuugucccugctt

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
uugagaauccauauguagatt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
ucuacauauggauucucaatt

SEQ ID NO: 1365 - DNA, 21 bp, Artificial Sequence
  Description of Artificial Sequence: Synthetic oligonucleotide
  Description of Combined DNA/RNA Molecule: Synthetic oligonucleotide
gacuacuucccagaauaugtt

SEQ ID NO: 1366 - DNA, 21 bp, Artificial Sequence
  Description of Artificial Sequence: Synthetic oligonucleotide
  Description of Combined DNA/RNA Molecule: Synthetic oligonucleotide
cauauucugggaaguaguctt

SEQ ID NO: 1367 - DNA, 21 bp, Artificial Sequence
  Description of Artificial Sequence: Synthetic oligonucleotide
  Description of Combined DNA/RNA Molecule: Synthetic oligonucleotide
ucaacgacgagaucgagcgtt

SEQ ID NO: 1368 - DNA, 21 bp, Artificial Sequence
  Description of Artificial Sequence: Synthetic oligonucleotide
  Description of Combined DNA/RNA Molecule: Synthetic oligonucleotide
cgcucgaucucgucguugatt

SEQ ID NO: 1369 - RNA, 19 nt, Artificial Sequence
  Description of Artificial Sequence: Synthetic oligonucleotide
uacuaauuuauugccgucc

SEQ ID NO: 1370 - RNA, 19 nt, Artificial Sequence
  Description of Artificial Sequence: Synthetic oligonucleotide
ggacggcaauaaauuagua

SEQ ID NO: 1371 - RNA, 19 nt, Artificial Sequence
  Description of Artificial Sequence: Synthetic oligonucleotide
cuaauuuauugccguccug

SEQ ID NO: 1372 - RNA, 19 nt, Artificial Sequence
  Description of Artificial Sequence: Synthetic oligonucleotide
caggacggcaauaaauuag

SEQ ID NO: 1373 - RNA, 19 nt, Artificial Sequence
  Description of Artificial Sequence: Synthetic oligonucleotide
acuaauuuauugccguccu

SEQ ID NO: 1374 - RNA, 19 nt, Artificial Sequence
  Description of Artificial Sequence: Synthetic oligonucleotide
aggacggcaauaaauuagu

SEQ ID NO: 1375 - RNA, 19 nt, Artificial Sequence
  Description of Artificial Sequence: Synthetic oligonucleotide
guacagucccagcacauuu

SEQ ID NO: 1376 - RNA, 19 nt, Artificial Sequence
  Description of Artificial Sequence: Synthetic oligonucleotide
aaaugugcugggacuguac

SEQ ID NO: 1377 - RNA, 19 nt, Artificial Sequence
  Description of Artificial Sequence: Synthetic oligonucleotide
auuuauugccguccuggac

SEQ ID NO: 1378 - RNA, 19 nt, Artificial Sequence
  Description of Artificial Sequence: Synthetic oligonucleotide
guccaggacggcaauaaau

SEQ ID NO: 1379 - RNA, 19 nt, Artificial Sequence
  Description of Artificial Sequence: Synthetic oligonucleotide
guaguaaauauuaugauuu

SEQ ID NO: 1380 - RNA, 19 nt, Artificial Sequence
  Description of Artificial Sequence: Synthetic oligonucleotide
aaaucauaauauuuacuac

SEQ ID NO: 1381 - RNA, 19 nt, Artificial Sequence
  Description of Artificial Sequence: Synthetic oligonucleotide
uaauuuauugccguccugg

SEQ ID NO: 1382 - RNA, 19 nt, Artificial Sequence
  Description of Artificial Sequence: Synthetic oligonucleotide
ccaggacggcaauaaauua

SEQ ID NO: 1383 - RNA, 19 nt, Artificial Sequence
  Description of Artificial Sequence: Synthetic oligonucleotide
acaagagggacuguauuuc

SEQ ID NO: 1384 - RNA, 19 nt, Artificial Sequence
  Description of Artificial Sequence: Synthetic oligonucleotide
gaaauacagucccucuugu

SEQ ID NO: 1385 - RNA, 19 nt, Artificial Sequence
  Description of Artificial Sequence: Synthetic oligonucleotide
uauugccguccuggacucu

SEQ ID NO: 1386 - RNA, 19 nt, Artificial Sequence
  Description of Artificial Sequence: Synthetic oligonucleotide
agaguccaggacggcaaua

SEQ ID NO: 1387 - RNA, 19 nt, Artificial Sequence
  Description of Artificial Sequence: Synthetic oligonucleotide
gaaguacagucccagcaca

SEQ ID NO: 1388 - RNA, 19 nt, Artificial Sequence
  Description of Artificial Sequence: Synthetic oligonucleotide
ugugcugggacuguacuuc

SEQ ID NO: 1389 - RNA, 19 nt, Artificial Sequence
  Description of Artificial Sequence: Synthetic oligonucleotide
auuuaaacuauucagagga

SEQ ID NO: 1390 - RNA, 19 nt, Artificial Sequence
  Description of Artificial Sequence: Synthetic oligonucleotide
uccucugaauaguuuaaau

SEQ ID NO: 1391 - RNA, 19 nt, Artificial Sequence
  Description of Artificial Sequence: Synthetic oligonucleotide
aauacuaauuuauugccgu

SEQ ID NO: 1392 - RNA, 19 nt, Artificial Sequence
  Description of Artificial Sequence: Synthetic oligonucleotide
acggcaauaaauuaguauu

SEQ ID NO: 1393 - RNA, 19 nt, Artificial Sequence
  Description of Artificial Sequence: Synthetic oligonucleotide
cagccauagcuugauugcu

SEQ ID NO: 1394 - RNA, 19 nt, Artificial Sequence
  Description of Artificial Sequence: Synthetic oligonucleotide
agcaaucaagcuauggcug

SEQ ID NO: 1395 - RNA, 19 nt, Artificial Sequence
  Description of Artificial Sequence: Synthetic oligonucleotide
gucaggacacaucguucga

SEQ ID NO: 1396 - RNA, 19 nt, Artificial Sequence
  Description of Artificial Sequence: Synthetic oligonucleotide
ucgaacgauguguccugac

SEQ ID NO: 1397 - RNA, 19 nt, Artificial Sequence
  Description of Artificial Sequence: Synthetic oligonucleotide
cuucccuggugggcuauug

SEQ ID NO: 1398 - RNA, 19 nt, Artificial Sequence
  Description of Artificial Sequence: Synthetic oligonucleotide
caauagcccaccagggaag

SEQ ID NO: 1399 - RNA, 19 nt, Artificial Sequence
  Description of Artificial Sequence: Synthetic oligonucleotide
gacacuacauuacccuaau

SEQ ID NO: 1400 - RNA, 19 nt, Artificial Sequence
  Description of Artificial Sequence: Synthetic oligonucleotide
auuaggguaauguaguguc

SEQ ID NO: 1401 - RNA, 19 nt, Artificial Sequence
  Description of Artificial Sequence: Synthetic oligonucleotide
acucugugugagcgugucc

SEQ ID NO: 1402 - RNA, 19 nt, Artificial Sequence
  Description of Artificial Sequence: Synthetic oligonucleotide
ggacacgcucacacagagu

SEQ ID NO: 1403 - RNA, 19 nt, Artificial Sequence
  Description of Artificial Sequence: Synthetic oligonucleotide
cccuggugggcuauugaag

SEQ ID NO: 1404 - RNA, 19 nt, Artificial Sequence
  Description of Artificial Sequence: Synthetic oligonucleotide
cuucaauagcccaccaggg

SEQ ID NO: 1405 - RNA, 19 nt, Artificial Sequence
  Description of Artificial Sequence: Synthetic oligonucleotide
cucucaaaugauacaguca

SEQ ID NO: 1406 - RNA, 19 nt, Artificial Sequence
  Description of Artificial Sequence: Synthetic oligonucleotide
ugacuguaucauuugagag

SEQ ID NO: 1407 - RNA, 19 nt, Artificial Sequence
  Description of Artificial Sequence: Synthetic oligonucleotide
aguacaaucuggucuaauu

SEQ ID NO: 1408 - RNA, 19 nt, Artificial Sequence
  Description of Artificial Sequence: Synthetic oligonucleotide
aauuagaccagauuguacu

SEQ ID NO: 1409 - RNA, 19 nt, Artificial Sequence
  Description of Artificial Sequence: Synthetic oligonucleotide
cacaaagauaagacuuguu

SEQ ID NO: 1410 - RNA, 19 nt, Artificial Sequence
  Description of Artificial Sequence: Synthetic oligonucleotide
aacaagucuuaucuuugug

SEQ ID NO: 1411 - RNA, 19 nt, Artificial Sequence
  Description of Artificial Sequence: Synthetic oligonucleotide
acaaucuggucuaauugug

SEQ ID NO: 1412 - RNA, 19 nt, Artificial Sequence
  Description of Artificial Sequence: Synthetic oligonucleotide
cacaauuagaccagauugu

SEQ ID NO: 1413 - RNA, 19 nt, Artificial Sequence
  Description of Artificial Sequence: Synthetic oligonucleotide
cagucaugcacucacaaag

SEQ ID NO: 1414 - RNA, 19 nt, Artificial Sequence
  Description of Artificial Sequence: Synthetic oligonucleotide
cuuugugagugcaugacug

SEQ ID NO: 1415 - RNA, 19 nt, Artificial Sequence
  Description of Artificial Sequence: Synthetic oligonucleotide
gacacaucguucgauuuaa

SEQ ID NO: 1416 - RNA, 19 nt, Artificial Sequence
  Description of Artificial Sequence: Synthetic oligonucleotide
uuaaaucgaacgauguguc

SEQ ID NO: 1417 - RNA, 19 nt, Artificial Sequence
  Description of Artificial Sequence: Synthetic oligonucleotide
cugcuacccagaaccuuuu

SEQ ID NO: 1418 - RNA, 19 nt, Artificial Sequence
  Description of Artificial Sequence: Synthetic oligonucleotide
aaaagguucuggguagcag

SEQ ID NO: 1419 - RNA, 19 nt, Artificial Sequence
  Description of Artificial Sequence: Synthetic oligonucleotide
ucagccauagcuugauugc

SEQ ID NO: 1420 - RNA, 19 nt, Artificial Sequence
  Description of Artificial Sequence: Synthetic oligonucleotide
gcaaucaagcuauggcuga

SEQ ID NO: 1421 - RNA, 19 nt, Artificial Sequence
  Description of Artificial Sequence: Synthetic oligonucleotide
caauuugcauaauacuaau

SEQ ID NO: 1422 - RNA, 19 nt, Artificial Sequence
  Description of Artificial Sequence: Synthetic oligonucleotide
auuaguauuaugcaaauug

SEQ ID NO: 1423 - RNA, 19 nt, Artificial Sequence
  Description of Artificial Sequence: Synthetic oligonucleotide
uaccuucagccauagcuug

SEQ ID NO: 1424 - RNA, 19 nt, Artificial Sequence
  Description of Artificial Sequence: Synthetic oligonucleotide
caagcuauggcugaaggua

SEQ ID NO: 1425 - RNA, 19 nt, Artificial Sequence
  Description of Artificial Sequence: Synthetic oligonucleotide
acagacacuacauuacccu

SEQ ID NO: 1426 - RNA, 19 nt, Artificial Sequence
  Description of Artificial Sequence: Synthetic oligonucleotide
aggguaauguagugucugu

SEQ ID NO: 1427 - RNA, 19 nt, Artificial Sequence
  Description of Artificial Sequence: Synthetic oligonucleotide
auacuaauuuauugccguc

SEQ ID NO: 1428 - RNA, 19 nt, Artificial Sequence
  Description of Artificial Sequence: Synthetic oligonucleotide
gacggcaauaaauuaguau

SEQ ID NO: 1429 - RNA, 19 nt, Artificial Sequence
  Description of Artificial Sequence: Synthetic oligonucleotide
gggcuauugaagauacaca

SEQ ID NO: 1430 - RNA, 19 nt, Artificial Sequence
  Description of Artificial Sequence: Synthetic oligonucleotide
uguguaucuucaauagccc

SEQ ID NO: 1431 - RNA, 19 nt, Artificial Sequence
  Description of Artificial Sequence: Synthetic oligonucleotide
guucgauuuaagccaucau

SEQ ID NO: 1432 - RNA, 19 nt, Artificial Sequence
  Description of Artificial Sequence: Synthetic oligonucleotide
augauggcuuaaaucgaac

SEQ ID NO: 1433 - RNA, 19 nt, Artificial Sequence
  Description of Artificial Sequence: Synthetic oligonucleotide
ugugccuccuagacacccg

SEQ ID NO: 1434 - RNA, 19 nt, Artificial Sequence
  Description of Artificial Sequence: Synthetic oligonucleotide
cgggugucuaggaggcaca

SEQ ID NO: 1435 - RNA, 19 nt, Artificial Sequence
  Description of Artificial Sequence: Synthetic oligonucleotide
cuggacucugugugagcgu

SEQ ID NO: 1436 - RNA, 19 nt, Artificial Sequence
  Description of Artificial Sequence: Synthetic oligonucleotide
acgcucacacagaguccag

SEQ ID NO: 1437 - RNA, 19 nt, Artificial Sequence
  Description of Artificial Sequence: Synthetic oligonucleotide
acccucucuuucaauugca

SEQ ID NO: 1438 - RNA, 19 nt, Artificial Sequence
  Description of Artificial Sequence: Synthetic oligonucleotide
ugcaauugaaagagagggu

SEQ ID NO: 1439 - RNA, 19 nt, Artificial Sequence
  Description of Artificial Sequence: Synthetic oligonucleotide
cagacacuacauuacccua

SEQ ID NO: 1440 - RNA, 19 nt, Artificial Sequence
  Description of Artificial Sequence: Synthetic oligonucleotide
uaggguaauguagugucug

SEQ ID NO: 1441 - RNA, 19 nt, Artificial Sequence
  Description of Artificial Sequence: Synthetic oligonucleotide
aauuuauugccguccugga

SEQ ID NO: 1442 - RNA, 19 nt, Artificial Sequence
  Description of Artificial Sequence: Synthetic oligonucleotide
uccaggacggcaauaaauu

SEQ ID NO: 1443 - RNA, 19 nt, Artificial Sequence
  Description of Artificial Sequence: Synthetic oligonucleotide
ugugugagcguguccacag

SEQ ID NO: 1444 - RNA, 19 nt, Artificial Sequence
  Description of Artificial Sequence: Synthetic oligonucleotide
cuguggacacgcucacaca

SEQ ID NO: 1445 - RNA, 19 nt, Artificial Sequence
  Description of Artificial Sequence: Synthetic oligonucleotide
ccuggugggcuauugaaga

SEQ ID NO: 1446 - RNA, 19 nt, Artificial Sequence
  Description of Artificial Sequence: Synthetic oligonucleotide
ucuucaauagcccaccagg

SEQ ID NO: 1447 - RNA, 19 nt, Artificial Sequence
  Description of Artificial Sequence: Synthetic oligonucleotide
accuucagccauagcuuga

SEQ ID NO: 1448 - RNA, 19 nt, Artificial Sequence
  Description of Artificial Sequence: Synthetic oligonucleotide
ucaagcuauggcugaaggu

SEQ ID NO: 1449 - RNA, 19 nt, Artificial Sequence
  Description of Artificial Sequence: Synthetic oligonucleotide
ggaugcugaaguacagucc

SEQ ID NO: 1450 - RNA, 19 nt, Artificial Sequence
  Description of Artificial Sequence: Synthetic oligonucleotide
ggacuguacuucagcaucc

SEQ ID NO: 1451 - RNA, 19 nt, Artificial Sequence
  Description of Artificial Sequence: Synthetic oligonucleotide
auccuaguuccauucuugg

SEQ ID NO: 1452 - RNA, 19 nt, Artificial Sequence
  Description of Artificial Sequence: Synthetic oligonucleotide
ccaagaauggaacuaggau

SEQ ID NO: 1453 - RNA, 19 nt, Artificial Sequence
  Description of Artificial Sequence: Synthetic oligonucleotide
uccuaguuccauucuuggu

SEQ ID NO: 1454 - RNA, 19 nt, Artificial Sequence
  Description of Artificial Sequence: Synthetic oligonucleotide
accaagaauggaacuagga

SEQ ID NO: 1455 - RNA, 19 nt, Artificial Sequence
  Description of Artificial Sequence: Synthetic oligonucleotide
ggaguacaaucuggucuaa

SEQ ID NO: 1456 - RNA, 19 nt, Artificial Sequence
  Description of Artificial Sequence: Synthetic oligonucleotide
uuagaccagauuguacucc

SEQ ID NO: 1457 - RNA, 19 nt, Artificial Sequence
  Description of Artificial Sequence: Synthetic oligonucleotide
cacauuuccucucuaucuu

SEQ ID NO: 1458 - RNA, 19 nt, Artificial Sequence
  Description of Artificial Sequence: Synthetic oligonucleotide
aagauagagaggaaaugug

SEQ ID NO: 1459 - RNA, 19 nt, Artificial Sequence
  Description of Artificial Sequence: Synthetic oligonucleotide
cacagaguuuguaguaaau

SEQ ID NO: 1460 - RNA, 19 nt, Artificial Sequence
  Description of Artificial Sequence: Synthetic oligonucleotide
auuuacuacaaacucugug

SEQ ID NO: 1461 - RNA, 19 nt, Artificial Sequence
  Description of Artificial Sequence: Synthetic oligonucleotide
aacagacacuacauuaccc

SEQ ID NO: 1462 - RNA, 19 nt, Artificial Sequence
  Description of Artificial Sequence: Synthetic oligonucleotide
ggguaauguagugucuguu

SEQ ID NO: 1463 - RNA, 19 nt, Artificial Sequence
  Description of Artificial Sequence: Synthetic oligonucleotide
uucucagucaugcacucac

SEQ ID NO: 1464 - RNA, 19 nt, Artificial Sequence
  Description of Artificial Sequence: Synthetic oligonucleotide
gugagugcaugacugagaa

SEQ ID NO: 1465 - RNA, 19 nt, Artificial Sequence
  Description of Artificial Sequence: Synthetic oligonucleotide
gugccuccuagacacccgc

SEQ ID NO: 1466 - RNA, 19 nt, Artificial Sequence
  Description of Artificial Sequence: Synthetic oligonucleotide
gcgggugucuaggaggcac

SEQ ID NO: 1467 - RNA, 19 nt, Artificial Sequence
  Description of Artificial Sequence: Synthetic oligonucleotide
aagccaucaucagcuuaau

SEQ ID NO: 1468 - RNA, 19 nt, Artificial Sequence
  Description of Artificial Sequence: Synthetic oligonucleotide
auuaagcugaugauggcuu

SEQ ID NO: 1469 - RNA, 19 nt, Artificial Sequence
  Description of Artificial Sequence: Synthetic oligonucleotide
cucucuuucaauugcagau

SEQ ID NO: 1470 - RNA, 19 nt, Artificial Sequence
  Description of Artificial Sequence: Synthetic oligonucleotide
aucugcaauugaaagagag

SEQ ID NO: 1471 - RNA, 19 nt, Artificial Sequence
  Description of Artificial Sequence: Synthetic oligonucleotide
acaccauccuccaguugaa

SEQ ID NO: 1472 - RNA, 19 nt, Artificial Sequence
  Description of Artificial Sequence: Synthetic oligonucleotide
uucaacuggaggauggugu

SEQ ID NO: 1473 - RNA, 19 nt, Artificial Sequence
  Description of Artificial Sequence: Synthetic oligonucleotide
uauccuaguuccauucuug

SEQ ID NO: 1474 - RNA, 19 nt, Artificial Sequence
  Description of Artificial Sequence: Synthetic oligonucleotide
caagaauggaacuaggaua

SEQ ID NO: 1475 - RNA, 19 nt, Artificial Sequence
  Description of Artificial Sequence: Synthetic oligonucleotide
caaucuggucuaauugugc

SEQ ID NO: 1476 - RNA, 19 nt, Artificial Sequence
  Description of Artificial Sequence: Synthetic oligonucleotide
gcacaauuagaccagauug

SEQ ID NO: 1477 - RNA, 19 nt, Artificial Sequence
  Description of Artificial Sequence: Synthetic oligonucleotide
ucaugcacucacaaagaua

SEQ ID NO: 1478 - RNA, 19 nt, Artificial Sequence
  Description of Artificial Sequence: Synthetic oligonucleotide
uaucuuugugagugcauga

SEQ ID NO: 1479 - RNA, 19 nt, Artificial Sequence
  Description of Artificial Sequence: Synthetic oligonucleotide
agacacuacauuacccuaa

SEQ ID NO: 1480 - RNA, 19 nt, Artificial Sequence
  Description of Artificial Sequence: Synthetic oligonucleotide
uuaggguaauguagugucu

SEQ ID NO: 1481 - RNA, 19 nt, Artificial Sequence
  Description of Artificial Sequence: Synthetic oligonucleotide
acacaagagggacuguauu

SEQ ID NO: 1482 - RNA, 19 nt, Artificial Sequence
  Description of Artificial Sequence: Synthetic oligonucleotide
aauacagucccucuugugu

SEQ ID NO: 1483 - RNA, 19 nt, Artificial Sequence
  Description of Artificial Sequence: Synthetic oligonucleotide
gaugcugaaguacaguccc

SEQ ID NO: 1484 - RNA, 19 nt, Artificial Sequence
  Description of Artificial Sequence: Synthetic oligonucleotide
gggacuguacuucagcauc

SEQ ID NO: 1485 - RNA, 19 nt, Artificial Sequence
  Description of Artificial Sequence: Synthetic oligonucleotide
agccauagcuugauugcuc

SEQ ID NO: 1486 - RNA, 19 nt, Artificial Sequence
  Description of Artificial Sequence: Synthetic oligonucleotide
gagcaaucaagcuauggcu

SEQ ID NO: 1487 - RNA, 19 nt, Artificial Sequence
  Description of Artificial Sequence: Synthetic oligonucleotide
cacaggaguccuuucuuuu

SEQ ID NO: 1488 - RNA, 19 nt, Artificial Sequence
  Description of Artificial Sequence: Synthetic oligonucleotide
aaaagaaaggacuccugug

SEQ ID NO: 1489 - RNA, 19 nt, Artificial Sequence
  Description of Artificial Sequence: Synthetic oligonucleotide
aucguucgauuuaagccau

SEQ ID NO: 1490 - RNA, 19 nt, Artificial Sequence
  Description of Artificial Sequence: Synthetic oligonucleotide
auggcuuaaaucgaacgau

SEQ ID NO: 1491 - RNA, 19 nt, Artificial Sequence
  Description of Artificial Sequence: Synthetic oligonucleotide
ucaucagcuuaauuuaagu

SEQ ID NO: 1492 - RNA, 19 nt, Artificial Sequence
  Description of Artificial Sequence: Synthetic oligonucleotide
acuuaaauuaagcugauga

SEQ ID NO: 1493 - RNA, 19 nt, Artificial Sequence
  Description of Artificial Sequence: Synthetic oligonucleotide
agcacauuuccucucuauc

SEQ ID NO: 1494 - RNA, 19 nt, Artificial Sequence
  Description of Artificial Sequence: Synthetic oligonucleotide
gauagagaggaaaugugcu

SEQ ID NO: 1495 - RNA, 19 nt, Artificial Sequence
  Description of Artificial Sequence: Synthetic oligonucleotide
gugggcuauugaagauaca

SEQ ID NO: 1496 - RNA, 19 nt, Artificial Sequence
  Description of Artificial Sequence: Synthetic oligonucleotide
uguaucuucaauagcccac

SEQ ID NO: 1497 - RNA, 19 nt, Artificial Sequence
  Description of Artificial Sequence: Synthetic oligonucleotide
aucauguauucccaucuag

SEQ ID NO: 1498 - RNA, 19 nt, Artificial Sequence
  Description of Artificial Sequence: Synthetic oligonucleotide
cuagaugggaauacaugau

SEQ ID NO: 1499 - RNA, 19 nt, Artificial Sequence
  Description of Artificial Sequence: Synthetic oligonucleotide
aaagacacacaggaguccu

SEQ ID NO: 1500 - RNA, 19 nt, Artificial Sequence
  Description of Artificial Sequence: Synthetic oligonucleotide
aggacuccugugugucuuu

SEQ ID NO: 1501 - RNA, 19 nt, Artificial Sequence
  Description of Artificial Sequence: Synthetic oligonucleotide
caaaugauacagucaggac

SEQ ID NO: 1502 - RNA, 19 nt, Artificial Sequence
  Description of Artificial Sequence: Synthetic oligonucleotide
guccugacuguaucauuug

SEQ ID NO: 1503 - RNA, 19 nt, Artificial Sequence
  Description of Artificial Sequence: Synthetic oligonucleotide
uuagaacaauuaucacaua

SEQ ID NO: 1504 - RNA, 19 nt, Artificial Sequence
  Description of Artificial Sequence: Synthetic oligonucleotide
uaugugauaauuguucuaa

SEQ ID NO: 1505 - RNA, 19 nt, Artificial Sequence
  Description of Artificial Sequence: Synthetic oligonucleotide
uccauucuuggucaaguuu

SEQ ID NO: 1506 - RNA, 19 nt, Artificial Sequence
  Description of Artificial Sequence: Synthetic oligonucleotide
aaacuugaccaagaaugga

SEQ ID NO: 1507 - RNA, 19 nt, Artificial Sequence
  Description of Artificial Sequence: Synthetic oligonucleotide
cuggucuaauugugccucc

SEQ ID NO: 1508 - RNA, 19 nt, Artificial Sequence
  Description of Artificial Sequence: Synthetic oligonucleotide
ggaggcacaauuagaccag

SEQ ID NO: 1509 - RNA, 19 nt, Artificial Sequence
  Description of Artificial Sequence: Synthetic oligonucleotide
cacaagagggacuguauuu

SEQ ID NO: 1510 - RNA, 19 nt, Artificial Sequence
  Description of Artificial Sequence: Synthetic oligonucleotide
aaauacagucccucuugug

SEQ ID NO: 1511 - RNA, 19 nt, Artificial Sequence
  Description of Artificial Sequence: Synthetic oligonucleotide
ucuugucucacuuuggacu

SEQ ID NO: 1512 - RNA, 19 nt, Artificial Sequence
  Description of Artificial Sequence: Synthetic oligonucleotide
aguccaaagugagacaaga

SEQ ID NO: 1513 - RNA, 19 nt, Artificial Sequence
  Description of Artificial Sequence: Synthetic oligonucleotide
uuuucuauggagcaaaaca

SEQ ID NO: 1514 - RNA, 19 nt, Artificial Sequence
  Description of Artificial Sequence: Synthetic oligonucleotide
uguuuugcuccauagaaaa

SEQ ID NO: 1515 - RNA, 19 nt, Artificial Sequence
  Description of Artificial Sequence: Synthetic oligonucleotide
uuuagaacaauuaucacau

SEQ ID NO: 1516 - RNA, 19 nt, Artificial Sequence
  Description of Artificial Sequence: Synthetic oligonucleotide
augugauaauuguucuaaa

SEQ ID NO: 1517 - RNA, 19 nt, Artificial Sequence
  Description of Artificial Sequence: Synthetic oligonucleotide
ggaguccuuucuuuugaaa

SEQ ID NO: 1518 - RNA, 19 nt, Artificial Sequence
  Description of Artificial Sequence: Synthetic oligonucleotide
uuucaaaagaaaggacucc

SEQ ID NO: 1519 - RNA, 19 nt, Artificial Sequence
  Description of Artificial Sequence: Synthetic oligonucleotide
uuaagccaucaucagcuua

SEQ ID NO: 1520 - RNA, 19 nt, Artificial Sequence
  Description of Artificial Sequence: Synthetic oligonucleotide
uaagcugaugauggcuuaa

SEQ ID NO: 1521 - RNA, 19 nt, Artificial Sequence
  Description of Artificial Sequence: Synthetic oligonucleotide
ucuaauugugccuccuaga

SEQ ID NO: 1522 - RNA, 19 nt, Artificial Sequence
  Description of Artificial Sequence: Synthetic oligonucleotide
ucuaggaggcacaauuaga

SEQ ID NO: 1523 - RNA, 19 nt, Artificial Sequence
  Description of Artificial Sequence: Synthetic oligonucleotide
aaguacagucccagcacau

SEQ ID NO: 1524 - RNA, 19 nt, Artificial Sequence
  Description of Artificial Sequence: Synthetic oligonucleotide
augugcugggacuguacuu

SEQ ID NO: 1525 - RNA, 19 nt, Artificial Sequence
  Description of Artificial Sequence: Synthetic oligonucleotide
cugaaguacagucccagca

SEQ ID NO: 1526 - RNA, 19 nt, Artificial Sequence
  Description of Artificial Sequence: Synthetic oligonucleotide
ugcugggacuguacuucag

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
uacuaauuuauugccgucctt

SEQ ID NO: 1528 - DNA, 21 bp, Artificial Sequence
  Description of Artificial Sequence: Synthetic oligonucleotide
  Description of Combined DNA/RNA Molecule: Synthetic oligonucleotide
ggacggcaauaaauuaguatt

SEQ ID NO: 1529 - DNA, 21 bp, Artificial Sequence
  Description of Artificial Sequence: Synthetic oligonucleotide
  Description of Combined DNA/RNA Molecule: Synthetic oligonucleotide
cuaauuuauugccguccugtt

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
caggacggcaauaaauuagtt

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
acuaauuuauugccguccutt

SEQ ID NO: 1532 - DNA, 21 bp, Artificial Sequence
  Description of Artificial Sequence: Synthetic oligonucleotide
  Description of Combined DNA/RNA Molecule: Synthetic oligonucleotide
aggacggcaauaaauuagutt

SEQ ID NO: 1533 - DNA, 21 bp, Artificial Sequence
  Description of Artificial Sequence: Synthetic oligonucleotide
  Description of Combined DNA/RNA Molecule: Synthetic oligonucleotide
guacagucccagcacauuutt

SEQ ID NO: 1534 - DNA, 21 bp, Artificial Sequence
  Description of Artificial Sequence: Synthetic oligonucleotide
  Description of Combined DNA/RNA Molecule: Synthetic oligonucleotide
aaaugugcugggacuguactt

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
auuuauugccguccuggactt

SEQ ID NO: 1536 - DNA, 21 bp, Artificial Sequence
  Description of Artificial Sequence: Synthetic oligonucleotide
  Description of Combined DNA/RNA Molecule: Synthetic oligonucleotide
guccaggacggcaauaaautt

SEQ ID NO: 1537 - DNA, 21 bp, Artificial Sequence
  Description of Artificial Sequence: Synthetic oligonucleotide
  Description of Combined DNA/RNA Molecule: Synthetic oligonucleotide
guaguaaauauuaugauuutt

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
aaaucauaauauuuacuactt

SEQ ID NO: 1539 - DNA, 21 bp, Artificial Sequence
  Description of Artificial Sequence: Synthetic oligonucleotide
  Description of Combined DNA/RNA Molecule: Synthetic oligonucleotide
uaauuuauugccguccuggtt

SEQ ID NO: 1540 - DNA, 21 bp, Artificial Sequence
  Description of Artificial Sequence: Synthetic oligonucleotide
  Description of Combined DNA/RNA Molecule: Synthetic oligonucleotide
ccaggacggcaauaaauuatt

SEQ ID NO: 1541 - DNA, 21 bp, Artificial Sequence
  Description of Artificial Sequence: Synthetic oligonucleotide
  Description of Combined DNA/RNA Molecule: Synthetic oligonucleotide
acaagagggacuguauuuctt

SEQ ID NO: 1542 - DNA, 21 bp, Artificial Sequence
  Description of Artificial Sequence: Synthetic oligonucleotide
  Description of Combined DNA/RNA Molecule: Synthetic oligonucleotide
gaaauacagucccucuugutt

SEQ ID NO: 1543 - DNA, 21 bp, Artificial Sequence
  Description of Artificial Sequence: Synthetic oligonucleotide
  Description of Combined DNA/RNA Molecule: Synthetic oligonucleotide
uauugccguccuggacucutt

SEQ ID NO: 1544 - DNA, 21 bp, Artificial Sequence
  Description of Artificial Sequence: Synthetic oligonucleotide
  Description of Combined DNA/RNA Molecule: Synthetic oligonucleotide
agaguccaggacggcaauatt

SEQ ID NO: 1545 - DNA, 21 bp, Artificial Sequence
  Description of Artificial Sequence: Synthetic oligonucleotide
  Description of Combined DNA/RNA Molecule: Synthetic oligonucleotide
gaaguacagucccagcacatt

SEQ ID NO: 1546 - DNA, 21 bp, Artificial Sequence
  Description of Artificial Sequence: Synthetic oligonucleotide
  Description of Combined DNA/RNA Molecule: Synthetic oligonucleotide
ugugcugggacuguacuuctt

SEQ ID NO: 1547 - DNA, 21 bp, Artificial Sequence
  Description of Artificial Sequence: Synthetic oligonucleotide
  Description of Combined DNA/RNA Molecule: Synthetic oligonucleotide
auuuaaacuauucagaggatt

SEQ ID NO: 1548 - DNA, 21 bp, Artificial Sequence
  Description of Artificial Sequence: Synthetic oligonucleotide
  Description of Combined DNA/RNA Molecule: Synthetic oligonucleotide
uccucugaauaguuuaaautt

SEQ ID NO: 1549 - DNA, 21 bp, Artificial Sequence
  Description of Artificial Sequence: Synthetic oligonucleotide
  Description of Combined DNA/RNA Molecule: Synthetic oligonucleotide
aauacuaauuuauugccgutt

SEQ ID NO: 1550 - DNA, 21 bp, Artificial Sequence
  Description of Artificial Sequence: Synthetic oligonucleotide
  Description of Combined DNA/RNA Molecule: Synthetic oligonucleotide
acggcaauaaauuaguauutt

SEQ ID NO: 1551 - DNA, 21 bp, Artificial Sequence
  Description of Artificial Sequence: Synthetic oligonucleotide
  Description of Combined DNA/RNA Molecule: Synthetic oligonucleotide
cagccauagcuugauugcutt

SEQ ID NO: 1552 - DNA, 21 bp, Artificial Sequence
  Description of Artificial Sequence: Synthetic oligonucleotide
  Description of Combined DNA/RNA Molecule: Synthetic oligonucleotide
agcaaucaagcuauggcugtt

SEQ ID NO: 1553 - DNA, 21 bp, Artificial Sequence
  Description of Artificial Sequence: Synthetic oligonucleotide
  Description of Combined DNA/RNA Molecule: Synthetic oligonucleotide
gucaggacacaucguucgatt

SEQ ID NO: 1554 - DNA, 21 bp, Artificial Sequence
  Description of Artificial Sequence: Synthetic oligonucleotide
  Description of Combined DNA/RNA Molecule: Synthetic oligonucleotide
ucgaacgauguguccugactt

SEQ ID NO: 1555 - DNA, 21 bp, Artificial Sequence
  Description of Artificial Sequence: Synthetic oligonucleotide
  Description of Combined DNA/RNA Molecule: Synthetic oligonucleotide
cuucccuggugggcuauugtt

SEQ ID NO: 1556 - DNA, 21 bp, Artificial Sequence
  Description of Artificial Sequence: Synthetic oligonucleotide
  Description of Combined DNA/RNA Molecule: Synthetic oligonucleotide
caauagcccaccagggaagtt

SEQ ID NO: 1557 - DNA, 21 bp, Artificial Sequence
  Description of Artificial Sequence: Synthetic oligonucleotide
  Description of Combined DNA/RNA Molecule: Synthetic oligonucleotide
gacacuacauuacccuaautt

SEQ ID NO: 1558 - DNA, 21 bp, Artificial Sequence
  Description of Artificial Sequence: Synthetic oligonucleotide
  Description of Combined DNA/RNA Molecule: Synthetic oligonucleotide
auuaggguaauguaguguctt

SEQ ID NO: 1559 - DNA, 21 bp, Artificial Sequence
  Description of Artificial Sequence: Synthetic oligonucleotide
  Description of Combined DNA/RNA Molecule: Synthetic oligonucleotide
acucugugugagcgugucctt

SEQ ID NO: 1560 - DNA, 21 bp, Artificial Sequence
  Description of Artificial Sequence: Synthetic oligonucleotide
  Description of Combined DNA/RNA Molecule: Synthetic oligonucleotide
ggacacgcucacacagagutt

SEQ ID NO: 1561 - DNA, 21 bp, Artificial Sequence
  Description of Artificial Sequence: Synthetic oligonucleotide
  Description of Combined DNA/RNA Molecule: Synthetic oligonucleotide
cccuggugggcuauugaagtt

SEQ ID NO: 1562 - DNA, 21 bp, Artificial Sequence
  Description of Artificial Sequence: Synthetic oligonucleotide
  Description of Combined DNA/RNA Molecule: Synthetic oligonucleotide
cuucaauagcccaccagggtt

SEQ ID NO: 1563 - DNA, 21 bp, Artificial Sequence
  Description of Artificial Sequence: Synthetic oligonucleotide
  Description of Combined DNA/RNA Molecule: Synthetic oligonucleotide
cucucaaaugauacagucatt

SEQ ID NO: 1564 - DNA, 21 bp, Artificial Sequence
  Description of Artificial Sequence: Synthetic oligonucleotide
  Description of Combined DNA/RNA Molecule: Synthetic oligonucleotide
ugacuguaucauuugagagtt

SEQ ID NO: 1565 - DNA, 21 bp, Artificial Sequence
  Description of Artificial Sequence: Synthetic oligonucleotide
  Description of Combined DNA/RNA Molecule: Synthetic oligonucleotide
aguacaaucuggucuaauutt

SEQ ID NO: 1566 - DNA, 21 bp, Artificial Sequence
  Description of Artificial Sequence: Synthetic oligonucleotide
  Description of Combined DNA/RNA Molecule: Synthetic oligonucleotide
aauuagaccagauuguacutt

SEQ ID NO: 1567 - DNA, 21 bp, Artificial Sequence
  Description of Artificial Sequence: Synthetic oligonucleotide
  Description of Combined DNA/RNA Molecule: Synthetic oligonucleotide
cacaaagauaagacuuguutt

SEQ ID NO: 1568 - DNA, 21 bp, Artificial Sequence
  Description of Artificial Sequence: Synthetic oligonucleotide
  Description of Combined DNA/RNA Molecule: Synthetic oligonucleotide
aacaagucuuaucuuugugtt

SEQ ID NO: 1569 - DNA, 21 bp, Artificial Sequence
  Description of Artificial Sequence: Synthetic oligonucleotide
  Description of Combined DNA/RNA Molecule: Synthetic oligonucleotide
acaaucuggucuaauugugtt

SEQ ID NO: 1570 - DNA, 21 bp, Artificial Sequence
  Description of Artificial Sequence: Synthetic oligonucleotide
  Description of Combined DNA/RNA Molecule: Synthetic oligonucleotide
cacaauuagaccagauugutt

SEQ ID NO: 1571 - DNA, 21 bp, Artificial Sequence
  Description of Artificial Sequence: Synthetic oligonucleotide
  Description of Combined DNA/RNA Molecule: Synthetic oligonucleotide
cagucaugcacucacaaagtt

SEQ ID NO: 1572 - DNA, 21 bp, Artificial Sequence
  Description of Artificial Sequence: Synthetic oligonucleotide
  Description of Combined DNA/RNA Molecule: Synthetic oligonucleotide
cuuugugagugcaugacugtt

SEQ ID NO: 1573 - DNA, 21 bp, Artificial Sequence
  Description of Artificial Sequence: Synthetic oligonucleotide
  Description of Combined DNA/RNA Molecule: Synthetic oligonucleotide
gacacaucguucgauuuaatt

SEQ ID NO: 1574 - DNA, 21 bp, Artificial Sequence
  Description of Artificial Sequence: Synthetic oligonucleotide
  Description of Combined DNA/RNA Molecule: Synthetic oligonucleotide
uuaaaucgaacgauguguctt

SEQ ID NO: 1575 - DNA, 21 bp, Artificial Sequence
  Description of Artificial Sequence: Synthetic oligonucleotide
  Description of Combined DNA/RNA Molecule: Synthetic oligonucleotide
cugcuacccagaaccuuuutt

SEQ ID NO: 1576 - DNA, 21 bp, Artificial Sequence
  Description of Artificial Sequence: Synthetic oligonucleotide
  Description of Combined DNA/RNA Molecule: Synthetic oligonucleotide
aaaagguucuggguagcagtt

SEQ ID NO: 1577 - DNA, 21 bp, Artificial Sequence
  Description of Artificial Sequence: Synthetic oligonucleotide
  Description of Combined DNA/RNA Molecule: Synthetic oligonucleotide
ucagccauagcuugauugctt

SEQ ID NO: 1578 - DNA, 21 bp, Artificial Sequence
  Description of Artificial Sequence: Synthetic oligonucleotide
  Description of Combined DNA/RNA Molecule: Synthetic oligonucleotide
gcaaucaagcuauggcugatt

SEQ ID NO: 1579 - DNA, 21 bp, Artificial Sequence
  Description of Artificial Sequence: Synthetic oligonucleotide
  Description of Combined DNA/RNA Molecule: Synthetic oligonucleotide
caauuugcauaauacuaautt

SEQ ID NO: 1580 - DNA, 21 bp, Artificial Sequence
  Description of Artificial Sequence: Synthetic oligonucleotide
  Description of Combined DNA/RNA Molecule: Synthetic oligonucleotide
auuaguauuaugcaaauugtt

SEQ ID NO: 1581 - DNA, 21 bp, Artificial Sequence
  Description of Artificial Sequence: Synthetic oligonucleotide
  Description of Combined DNA/RNA Molecule: Synthetic oligonucleotide
uaccuucagccauagcuugtt

SEQ ID NO: 1582 - DNA, 21 bp, Artificial Sequence
  Description of Artificial Sequence: Synthetic oligonucleotide
  Description of Combined DNA/RNA Molecule: Synthetic oligonucleotide
caagcuauggcugaagguatt

SEQ ID NO: 1583 - DNA, 21 bp, Artificial Sequence
  Description of Artificial Sequence: Synthetic oligonucleotide
  Description of Combined DNA/RNA Molecule: Synthetic oligonucleotide
acagacacuacauuacccutt

SEQ ID NO: 1584 - DNA, 21 bp, Artificial Sequence
  Description of Artificial Sequence: Synthetic oligonucleotide
  Description of Combined DNA/RNA Molecule: Synthetic oligonucleotide
aggguaauguagugucugutt

SEQ ID NO: 1585 - DNA, 21 bp, Artificial Sequence
  Description of Artificial Sequence: Synthetic oligonucleotide
  Description of Combined DNA/RNA Molecule: Synthetic oligonucleotide
auacuaauuuauugccguctt

SEQ ID NO: 1586 - DNA, 21 bp, Artificial Sequence
  Description of Artificial Sequence: Synthetic oligonucleotide
  Description of Combined DNA/RNA Molecule: Synthetic oligonucleotide
gacggcaauaaauuaguautt

SEQ ID NO: 1587 - DNA, 21 bp, Artificial Sequence
  Description of Artificial Sequence: Synthetic oligonucleotide
  Description of Combined DNA/RNA Molecule: Synthetic oligonucleotide
gggcuauugaagauacacatt

SEQ ID NO: 1588 - DNA, 21 bp, Artificial Sequence
  Description of Artificial Sequence: Synthetic oligonucleotide
  Description of Combined DNA/RNA Molecule: Synthetic oligonucleotide
uguguaucuucaauagccctt

SEQ ID NO: 1589 - DNA, 21 bp, Artificial Sequence
  Description of Artificial Sequence: Synthetic oligonucleotide
  Description of Combined DNA/RNA Molecule: Synthetic oligonucleotide
guucgauuuaagccaucautt

SEQ ID NO: 1590 - DNA, 21 bp, Artificial Sequence
  Description of Artificial Sequence: Synthetic oligonucleotide
  Description of Combined DNA/RNA Molecule: Synthetic oligonucleotide
augauggcuuaaaucgaactt

SEQ ID NO: 1591 - DNA, 21 bp, Artificial Sequence
  Description of Artificial Sequence: Synthetic oligonucleotide
  Description of Combined DNA/RNA Molecule: Synthetic oligonucleotide
ugugccuccuagacacccgtt

SEQ ID NO: 1592 - DNA, 21 bp, Artificial Sequence
  Description of Artificial Sequence: Synthetic oligonucleotide
  Description of Combined DNA/RNA Molecule: Synthetic oligonucleotide
cgggugucuaggaggcacatt

SEQ ID NO: 1593 - DNA, 21 bp, Artificial Sequence
  Description of Artificial Sequence: Synthetic oligonucleotide
  Description of Combined DNA/RNA Molecule: Synthetic oligonucleotide
cuggacucugugugagcgutt

SEQ ID NO: 1594 - DNA, 21 bp, Artificial Sequence
  Description of Artificial Sequence: Synthetic oligonucleotide
  Description of Combined DNA/RNA Molecule: Synthetic oligonucleotide
acgcucacacagaguccagtt

SEQ ID NO: 1595 - DNA, 21 bp, Artificial Sequence
  Description of Artificial Sequence: Synthetic oligonucleotide
  Description of Combined DNA/RNA Molecule: Synthetic oligonucleotide
acccucucuuucaauugcatt

SEQ ID NO: 1596 - DNA, 21 bp, Artificial Sequence
  Description of Artificial Sequence: Synthetic oligonucleotide
  Description of Combined DNA/RNA Molecule: Synthetic oligonucleotide
ugcaauugaaagagagggutt

SEQ ID NO: 1597 - DNA, 21 bp, Artificial Sequence
  Description of Artificial Sequence: Synthetic oligonucleotide
  Description of Combined DNA/RNA Molecule: Synthetic oligonucleotide
cagacacuacauuacccuatt

SEQ ID NO: 1598 - DNA, 21 bp, Artificial Sequence
  Description of Artificial Sequence: Synthetic oligonucleotide
  Description of Combined DNA/RNA Molecule: Synthetic oligonucleotide
uaggguaauguagugucugtt

SEQ ID NO: 1599 - DNA, 21 bp, Artificial Sequence
  Description of Artificial Sequence: Synthetic oligonucleotide
  Description of Combined DNA/RNA Molecule: Synthetic oligonucleotide
aauuuauugccguccuggatt

SEQ ID NO: 1600 - DNA, 21 bp, Artificial Sequence
  Description of Artificial Sequence: Synthetic oligonucleotide
  Description of Combined DNA/RNA Molecule: Synthetic oligonucleotide
uccaggacggcaauaaauutt

SEQ ID NO: 1601 - DNA, 21 bp, Artificial Sequence
  Description of Artificial Sequence: Synthetic oligonucleotide
  Description of Combined DNA/RNA Molecule: Synthetic oligonucleotide
ugugugagcguguccacagtt

SEQ ID NO: 1602 - DNA, 21 bp, Artificial Sequence
  Description of Artificial Sequence: Synthetic oligonucleotide
  Description of Combined DNA/RNA Molecule: Synthetic oligonucleotide
cuguggacacgcucacacatt

SEQ ID NO: 1603 - DNA, 21 bp, Artificial Sequence
  Description of Artificial Sequence: Synthetic oligonucleotide
  Description of Combined DNA/RNA Molecule: Synthetic oligonucleotide
ccuggugggcuauugaagatt

SEQ ID NO: 1604 - DNA, 21 bp, Artificial Sequence
  Description of Artificial Sequence: Synthetic oligonucleotide
  Description of Combined DNA/RNA Molecule: Synthetic oligonucleotide
ucuucaauagcccaccaggtt

SEQ ID NO: 1605 - DNA, 21 bp, Artificial Sequence
  Description of Artificial Sequence: Synthetic oligonucleotide
  Description of Combined DNA/RNA Molecule: Synthetic oligonucleotide
accuucagccauagcuugatt

SEQ ID NO: 1606 - DNA, 21 bp, Artificial Sequence
  Description of Artificial Sequence: Synthetic oligonucleotide
  Description of Combined DNA/RNA Molecule: Synthetic oligonucleotide
ucaagcuauggcugaaggutt

SEQ ID NO: 1607 - DNA, 21 bp, Artificial Sequence
  Description of Artificial Sequence: Synthetic oligonucleotide
  Description of Combined DNA/RNA Molecule: Synthetic oligonucleotide
ggaugcugaaguacagucctt

SEQ ID NO: 1608 - DNA, 21 bp, Artificial Sequence
  Description of Artificial Sequence: Synthetic oligonucleotide
  Description of Combined DNA/RNA Molecule: Synthetic oligonucleotide
ggacuguacuucagcaucctt

SEQ ID NO: 1609 - DNA, 21 bp, Artificial Sequence
  Description of Artificial Sequence: Synthetic oligonucleotide
  Description of Combined DNA/RNA Molecule: Synthetic oligonucleotide
auccuaguuccauucuuggtt

SEQ ID NO: 1610 - DNA, 21 bp, Artificial Sequence
  Description of Artificial Sequence: Synthetic oligonucleotide
  Description of Combined DNA/RNA Molecule: Synthetic oligonucleotide
ccaagaauggaacuaggautt

SEQ ID NO: 1611 - DNA, 21 bp, Artificial Sequence
  Description of Artificial Sequence: Synthetic oligonucleotide
  Description of Combined DNA/RNA Molecule: Synthetic oligonucleotide
uccuaguuccauucuuggutt

SEQ ID NO: 1612 - DNA, 21 bp, Artificial Sequence
  Description of Artificial Sequence: Synthetic oligonucleotide
  Description of Combined DNA/RNA Molecule: Synthetic oligonucleotide
accaagaauggaacuaggatt

SEQ ID NO: 1613 - DNA, 21 bp, Artificial Sequence
  Description of Artificial Sequence: Synthetic oligonucleotide
  Description of Combined DNA/RNA Molecule: Synthetic oligonucleotide
ggaguacaaucuggucuaatt

SEQ ID NO: 1614 - DNA, 21 bp, Artificial Sequence
  Description of Artificial Sequence: Synthetic oligonucleotide
  Description of Combined DNA/RNA Molecule: Synthetic oligonucleotide
uuagaccagauuguacucctt

SEQ ID NO: 1615 - DNA, 21 bp, Artificial Sequence
  Description of Artificial Sequence: Synthetic oligonucleotide
  Description of Combined DNA/RNA Molecule: Synthetic oligonucleotide
cacauuuccucucuaucuutt

SEQ ID NO: 1616 - DNA, 21 bp, Artificial Sequence
  Description of Artificial Sequence: Synthetic oligonucleotide
  Description of Combined DNA/RNA Molecule: Synthetic oligonucleotide
aagauagagaggaaaugugtt

SEQ ID NO: 1617 - DNA, 21 bp, Artificial Sequence
  Description of Artificial Sequence: Synthetic oligonucleotide
  Description of Combined DNA/RNA Molecule: Synthetic oligonucleotide
cacagaguuuguaguaaautt

SEQ ID NO: 1618 - DNA, 21 bp, Artificial Sequence
  Description of Artificial Sequence: Synthetic oligonucleotide
  Description of Combined DNA/RNA Molecule: Synthetic oligonucleotide
auuuacuacaaacucugugtt

SEQ ID NO: 1619 - DNA, 21 bp, Artificial Sequence
  Description of Artificial Sequence: Synthetic oligonucleotide
  Description of Combined DNA/RNA Molecule: Synthetic oligonucleotide
aacagacacuacauuaccctt

SEQ ID NO: 1620 - DNA, 21 bp, Artificial Sequence
  Description of Artificial Sequence: Synthetic oligonucleotide
  Description of Combined DNA/RNA Molecule: Synthetic oligonucleotide
ggguaauguagugucuguutt

SEQ ID NO: 1621 - DNA, 21 bp, Artificial Sequence
  Description of Artificial Sequence: Synthetic oligonucleotide
  Description of Combined DNA/RNA Molecule: Synthetic oligonucleotide
uucucagucaugcacucactt

SEQ ID NO: 1622 - DNA, 21 bp, Artificial Sequence
  Description of Artificial Sequence: Synthetic oligonucleotide
  Description of Combined DNA/RNA Molecule: Synthetic oligonucleotide
gugagugcaugacugagaatt

SEQ ID NO: 1623 - DNA, 21 bp, Artificial Sequence
  Description of Artificial Sequence: Synthetic oligonucleotide
  Description of Combined DNA/RNA Molecule: Synthetic oligonucleotide
gugccuccuagacacccgctt

SEQ ID NO: 1624 - DNA, 21 bp, Artificial Sequence
  Description of Artificial Sequence: Synthetic oligonucleotide
  Description of Combined DNA/RNA Molecule: Synthetic oligonucleotide
gcgggugucuaggaggcactt

SEQ ID NO: 1625 - DNA, 21 bp, Artificial Sequence
  Description of Artificial Sequence: Synthetic oligonucleotide
  Description of Combined DNA/RNA Molecule: Synthetic oligonucleotide
aagccaucaucagcuuaautt

SEQ ID NO: 1626 - DNA, 21 bp, Artificial Sequence
  Description of Artificial Sequence: Synthetic oligonucleotide
  Description of Combined DNA/RNA Molecule: Synthetic oligonucleotide
auuaagcugaugauggcuutt

SEQ ID NO: 1627 - DNA, 21 bp, Artificial Sequence
  Description of Artificial Sequence: Synthetic oligonucleotide
  Description of Combined DNA/RNA Molecule: Synthetic oligonucleotide
cucucuuucaauugcagautt

SEQ ID NO: 1628 - DNA, 21 bp, Artificial Sequence
  Description of Artificial Sequence: Synthetic oligonucleotide
  Description of Combined DNA/RNA Molecule: Synthetic oligonucleotide
aucugcaauugaaagagagtt

SEQ ID NO: 1629 - DNA, 21 bp, Artificial Sequence
  Description of Artificial Sequence: Synthetic oligonucleotide
  Description of Combined DNA/RNA Molecule: Synthetic oligonucleotide
acaccauccuccaguugaatt

SEQ ID NO: 1630 - DNA, 21 bp, Artificial Sequence
  Description of Artificial Sequence: Synthetic oligonucleotide
  Description of Combined DNA/RNA Molecule: Synthetic oligonucleotide
uucaacuggaggauggugutt

SEQ ID NO: 1631 - DNA, 21 bp, Artificial Sequence
  Description of Artificial Sequence: Synthetic oligonucleotide
  Description of Combined DNA/RNA Molecule: Synthetic oligonucleotide
uauccuaguuccauucuugtt

SEQ ID NO: 1632 - DNA, 21 bp, Artificial Sequence
  Description of Artificial Sequence: Synthetic oligonucleotide
  Description of Combined DNA/RNA Molecule: Synthetic oligonucleotide
caagaauggaacuaggauatt

SEQ ID NO: 1633 - DNA, 21 bp, Artificial Sequence
  Description of Artificial Sequence: Synthetic oligonucleotide
  Description of Combined DNA/RNA Molecule: Synthetic oligonucleotide
caaucuggucuaauugugctt

SEQ ID NO: 1634 - DNA, 21 bp, Artificial Sequence
  Description of Artificial Sequence: Synthetic oligonucleotide
  Description of Combined DNA/RNA Molecule: Synthetic oligonucleotide
gcacaauuagaccagauugtt

SEQ ID NO: 1635 - DNA, 21 bp, Artificial Sequence
  Description of Artificial Sequence: Synthetic oligonucleotide
  Description of Combined DNA/RNA Molecule: Synthetic oligonucleotide
ucaugcacucacaaagauatt

SEQ ID NO: 1636 - DNA, 21 bp, Artificial Sequence
  Description of Artificial Sequence: Synthetic oligonucleotide
  Description of Combined DNA/RNA Molecule: Synthetic oligonucleotide
uaucuuugugagugcaugatt

SEQ ID NO: 1637 - DNA, 21 bp, Artificial Sequence
  Description of Artificial Sequence: Synthetic oligonucleotide
  Description of Combined DNA/RNA Molecule: Synthetic oligonucleotide
agacacuacauuacccuaatt

SEQ ID NO: 1638 - DNA, 21 bp, Artificial Sequence
  Description of Artificial Sequence: Synthetic oligonucleotide
  Description of Combined DNA/RNA Molecule: Synthetic oligonucleotide
uuaggguaauguagugucutt

SEQ ID NO: 1639 - DNA, 21 bp, Artificial Sequence
  Description of Artificial Sequence: Synthetic oligonucleotide
  Description of Combined DNA/RNA Molecule: Synthetic oligonucleotide
acacaagagggacuguauutt

SEQ ID NO: 1640 - DNA, 21 bp, Artificial Sequence
  Description of Artificial Sequence: Synthetic oligonucleotide
  Description of Combined DNA/RNA Molecule: Synthetic oligonucleotide
aauacagucccucuugugutt

SEQ ID NO: 1641 - DNA, 21 bp, Artificial Sequence
  Description of Artificial Sequence: Synthetic oligonucleotide
  Description of Combined DNA/RNA Molecule: Synthetic oligonucleotide
gaugcugaaguacaguccctt

SEQ ID NO: 1642 - DNA, 21 bp, Artificial Sequence
  Description of Artificial Sequence: Synthetic oligonucleotide
  Description of Combined DNA/RNA Molecule: Synthetic oligonucleotide
gggacuguacuucagcauctt

SEQ ID NO: 1643 - DNA, 21 bp, Artificial Sequence
  Description of Artificial Sequence: Synthetic oligonucleotide
  Description of Combined DNA/RNA Molecule: Synthetic oligonucleotide
agccauagcuugauugcuctt

SEQ ID NO: 1644 - DNA, 21 bp, Artificial Sequence
  Description of Artificial Sequence: Synthetic oligonucleotide
  Description of Combined DNA/RNA Molecule: Synthetic oligonucleotide
gagcaaucaagcuauggcutt

SEQ ID NO: 1645 - DNA, 21 bp, Artificial Sequence
  Description of Artificial Sequence: Synthetic oligonucleotide
  Description of Combined DNA/RNA Molecule: Synthetic oligonucleotide
cacaggaguccuuucuuuutt

SEQ ID NO: 1646 - DNA, 21 bp, Artificial Sequence
  Description of Artificial Sequence: Synthetic oligonucleotide
  Description of Combined DNA/RNA Molecule: Synthetic oligonucleotide
aaaagaaaggacuccugugtt

SEQ ID NO: 1647 - DNA, 21 bp, Artificial Sequence
  Description of Artificial Sequence: Synthetic oligonucleotide
  Description of Combined DNA/RNA Molecule: Synthetic oligonucleotide
aucguucgauuuaagccautt

SEQ ID NO: 1648 - DNA, 21 bp, Artificial Sequence
  Description of Artificial Sequence: Synthetic oligonucleotide
  Description of Combined DNA/RNA Molecule: Synthetic oligonucleotide
auggcuuaaaucgaacgautt

SEQ ID NO: 1649 - DNA, 21 bp, Artificial Sequence
  Description of Artificial Sequence: Synthetic oligonucleotide
  Description of Combined DNA/RNA Molecule: Synthetic oligonucleotide
ucaucagcuuaauuuaagutt

SEQ ID NO: 1650 - DNA, 21 bp, Artificial Sequence
  Description of Artificial Sequence: Synthetic oligonucleotide
  Description of Combined DNA/RNA Molecule: Synthetic oligonucleotide
acuuaaauuaagcugaugatt

SEQ ID NO: 1651 - DNA, 21 bp, Artificial Sequence
  Description of Artificial Sequence: Synthetic oligonucleotide
  Description of Combined DNA/RNA Molecule: Synthetic oligonucleotide
agcacauuuccucucuauctt

SEQ ID NO: 1652 - DNA, 21 bp, Artificial Sequence
  Description of Artificial Sequence: Synthetic oligonucleotide
  Description of Combined DNA/RNA Molecule: Synthetic oligonucleotide
gauagagaggaaaugugcutt

SEQ ID NO: 1653 - DNA, 21 bp, Artificial Sequence
  Description of Artificial Sequence: Synthetic oligonucleotide
  Description of Combined DNA/RNA Molecule: Synthetic oligonucleotide
gugggcuauugaagauacatt

SEQ ID NO: 1654 - DNA, 21 bp, Artificial Sequence
  Description of Artificial Sequence: Synthetic oligonucleotide
  Description of Combined DNA/RNA Molecule: Synthetic oligonucleotide
uguaucuucaauagcccactt

SEQ ID NO: 1655 - DNA, 21 bp, Artificial Sequence
  Description of Artificial Sequence: Synthetic oligonucleotide
  Description of Combined DNA/RNA Molecule: Synthetic oligonucleotide
aucauguauucccaucuagtt

SEQ ID NO: 1656 - DNA, 21 bp, Artificial Sequence
  Description of Artificial Sequence: Synthetic oligonucleotide
  Description of Combined DNA/RNA Molecule: Synthetic oligonucleotide
cuagaugggaauacaugautt

SEQ ID NO: 1657 - DNA, 21 bp, Artificial Sequence
  Description of Artificial Sequence: Synthetic oligonucleotide
  Description of Combined DNA/RNA Molecule: Synthetic oligonucleotide
aaagacacacaggaguccutt

SEQ ID NO: 1658 - DNA, 21 bp, Artificial Sequence
  Description of Artificial Sequence: Synthetic oligonucleotide
  Description of Combined DNA/RNA Molecule: Synthetic oligonucleotide
aggacuccugugugucuuutt

SEQ ID NO: 1659 - DNA, 21 bp, Artificial Sequence
  Description of Artificial Sequence: Synthetic oligonucleotide
  Description of Combined DNA/RNA Molecule: Synthetic oligonucleotide
caaaugauacagucaggactt

SEQ ID NO: 1660 - DNA, 21 bp, Artificial Sequence
  Description of Artificial Sequence: Synthetic oligonucleotide
  Description of Combined DNA/RNA Molecule: Synthetic oligonucleotide
guccugacuguaucauuugtt

SEQ ID NO: 1661 - DNA, 21 bp, Artificial Sequence
  Description of Artificial Sequence: Synthetic oligonucleotide
  Description of Combined DNA/RNA Molecule: Synthetic oligonucleotide
uuagaacaauuaucacauatt

SEQ ID NO: 1662 - DNA, 21 bp, Artificial Sequence
  Description of Artificial Sequence: Synthetic oligonucleotide
  Description of Combined DNA/RNA Molecule: Synthetic oligonucleotide
uaugugauaauuguucuaatt

SEQ ID NO: 1663 - DNA, 21 bp, Artificial Sequence
  Description of Artificial Sequence: Synthetic oligonucleotide
  Description of Combined DNA/RNA Molecule: Synthetic oligonucleotide
uccauucuuggucaaguuutt

SEQ ID NO: 1664 - DNA, 21 bp, Artificial Sequence
  Description of Artificial Sequence: Synthetic oligonucleotide
  Description of Combined DNA/RNA Molecule: Synthetic oligonucleotide
aaacuugaccaagaauggatt

SEQ ID NO: 1665 - DNA, 21 bp, Artificial Sequence
  Description of Artificial Sequence: Synthetic oligonucleotide
  Description of Combined DNA/RNA Molecule: Synthetic oligonucleotide
cuggucuaauugugccucctt

SEQ ID NO: 1666 - DNA, 21 bp, Artificial Sequence
  Description of Artificial Sequence: Synthetic oligonucleotide
  Description of Combined DNA/RNA Molecule: Synthetic oligonucleotide
ggaggcacaauuagaccagtt

SEQ ID NO: 1667 - DNA, 21 bp, Artificial Sequence
  Description of Artificial Sequence: Synthetic oligonucleotide
  Description of Combined DNA/RNA Molecule: Synthetic oligonucleotide
cacaagagggacuguauuutt

SEQ ID NO: 1668 - DNA, 21 bp, Artificial Sequence
  Description of Artificial Sequence: Synthetic oligonucleotide
  Description of Combined DNA/RNA Molecule: Synthetic oligonucleotide
aaauacagucccucuugugtt

SEQ ID NO: 1669 - DNA, 21 bp, Artificial Sequence
  Description of Artificial Sequence: Synthetic oligonucleotide
  Description of Combined DNA/RNA Molecule: Synthetic oligonucleotide
ucuugucucacuuuggacutt

SEQ ID NO: 1670 - DNA, 21 bp, Artificial Sequence
  Description of Artificial Sequence: Synthetic oligonucleotide
  Description of Combined DNA/RNA Molecule: Synthetic oligonucleotide
aguccaaagugagacaagatt

SEQ ID NO: 1671 - DNA, 21 bp, Artificial Sequence
  Description of Artificial Sequence: Synthetic oligonucleotide
  Description of Combined DNA/RNA Molecule: Synthetic oligonucleotide
uuuucuauggagcaaaacatt

SEQ ID NO: 1672 - DNA, 21 bp, Artificial Sequence
  Description of Artificial Sequence: Synthetic oligonucleotide
  Description of Combined DNA/RNA Molecule: Synthetic oligonucleotide
uguuuugcuccauagaaaatt

SEQ ID NO: 1673 - DNA, 21 bp, Artificial Sequence
  Description of Artificial Sequence: Synthetic oligonucleotide
  Description of Combined DNA/RNA Molecule: Synthetic oligonucleotide
uuuagaacaauuaucacautt

SEQ ID NO: 1674 - DNA, 21 bp, Artificial Sequence
  Description of Artificial Sequence: Synthetic oligonucleotide
  Description of Combined DNA/RNA Molecule: Synthetic oligonucleotide
augugauaauuguucuaaatt

SEQ ID NO: 1675 - DNA, 21 bp, Artificial Sequence
  Description of Artificial Sequence: Synthetic oligonucleotide
  Description of Combined DNA/RNA Molecule: Synthetic oligonucleotide
ggaguccuuucuuuugaaatt

SEQ ID NO: 1676 - DNA, 21 bp, Artificial Sequence
  Description of Artificial Sequence: Synthetic oligonucleotide
  Description of Combined DNA/RNA Molecule: Synthetic oligonucleotide
uuucaaaagaaaggacucctt

SEQ ID NO: 1677 - DNA, 21 bp, Artificial Sequence
  Description of Artificial Sequence: Synthetic oligonucleotide
  Description of Combined DNA/RNA Molecule: Synthetic oligonucleotide
uuaagccaucaucagcuuatt

SEQ ID NO: 1678 - DNA, 21 bp, Artificial Sequence
  Description of Artificial Sequence: Synthetic oligonucleotide
  Description of Combined DNA/RNA Molecule: Synthetic oligonucleotide
uaagcugaugauggcuuaatt

SEQ ID NO: 1679 - DNA, 21 bp, Artificial Sequence
  Description of Artificial Sequence: Synthetic oligonucleotide
  Description of Combined DNA/RNA Molecule: Synthetic oligonucleotide
ucuaauugugccuccuagatt

SEQ ID NO: 1680 - DNA, 21 bp, Artificial Sequence
  Description of Artificial Sequence: Synthetic oligonucleotide
  Description of Combined DNA/RNA Molecule: Synthetic oligonucleotide
ucuaggaggcacaauuagatt

SEQ ID NO: 1681 - DNA, 21 bp, Artificial Sequence
  Description of Artificial Sequence: Synthetic oligonucleotide
  Description of Combined DNA/RNA Molecule: Synthetic oligonucleotide
aaguacagucccagcacautt

SEQ ID NO: 1682 - DNA, 21 bp, Artificial Sequence
  Description of Artificial Sequence: Synthetic oligonucleotide
  Description of Combined DNA/RNA Molecule: Synthetic oligonucleotide
augugcugggacuguacuutt

SEQ ID NO: 1683 - DNA, 21 bp, Artificial Sequence
  Description of Artificial Sequence: Synthetic oligonucleotide
  Description of Combined DNA/RNA Molecule: Synthetic oligonucleotide
cugaaguacagucccagcatt

SEQ ID NO: 1684 - DNA, 21 bp, Artificial Sequence
  Description of Artificial Sequence: Synthetic oligonucleotide
  Description of Combined DNA/RNA Molecule: Synthetic oligonucleotide
ugcugggacuguacuucagtt

SEQ ID NO: 1685 - RNA, 19 nt, Artificial Sequence
  Description of Artificial Sequence: Synthetic oligonucleotide
uauucccaccuagucgacu

SEQ ID NO: 1686 - RNA, 19 nt, Artificial Sequence
  Description of Artificial Sequence: Synthetic oligonucleotide
agucgacuaggugggaaua

SEQ ID NO: 1687 - RNA, 19 nt, Artificial Sequence
  Description of Artificial Sequence: Synthetic oligonucleotide
uucccaccuagucgacuac

SEQ ID NO: 1688 - RNA, 19 nt, Artificial Sequence
  Description of Artificial Sequence: Synthetic oligonucleotide
guagucgacuaggugggaa

SEQ ID NO: 1689 - RNA, 19 nt, Artificial Sequence
  Description of Artificial Sequence: Synthetic oligonucleotide
gcuuuugagaauccauaug

SEQ ID NO: 1690 - RNA, 19 nt, Artificial Sequence
  Description of Artificial Sequence: Synthetic oligonucleotide
cauauggauucucaaaagc

SEQ ID NO: 1691 - RNA, 19 nt, Artificial Sequence
  Description of Artificial Sequence: Synthetic oligonucleotide
cggaggaucaacgacgaga

SEQ ID NO: 1692 - RNA, 19 nt, Artificial Sequence
  Description of Artificial Sequence: Synthetic oligonucleotide
ucucgucguugauccuccg

SEQ ID NO: 1693 - RNA, 19 nt, Artificial Sequence
  Description of Artificial Sequence: Synthetic oligonucleotide
aucugacucuaccaaauac

SEQ ID NO: 1694 - RNA, 19 nt, Artificial Sequence
  Description of Artificial Sequence: Synthetic oligonucleotide
guauuugguagagucagau

SEQ ID NO: 1695 - RNA, 19 nt, Artificial Sequence
  Description of Artificial Sequence: Synthetic oligonucleotide
acacaauaaggcucaugca

SEQ ID NO: 1696 - RNA, 19 nt, Artificial Sequence
  Description of Artificial Sequence: Synthetic oligonucleotide
ugcaugagccuuauugugu

SEQ ID NO: 1697 - RNA, 19 nt, Artificial Sequence
  Description of Artificial Sequence: Synthetic oligonucleotide
aggaucauccacgggucgg

SEQ ID NO: 1698 - RNA, 19 nt, Artificial Sequence
  Description of Artificial Sequence: Synthetic oligonucleotide
ccgacccguggaugauccu

SEQ ID NO: 1699 - RNA, 19 nt, Artificial Sequence
  Description of Artificial Sequence: Synthetic oligonucleotide
cccauacaaguaugaacac

SEQ ID NO: 1700 - RNA, 19 nt, Artificial Sequence
  Description of Artificial Sequence: Synthetic oligonucleotide
guguucauacuuguauggg

SEQ ID NO: 1701 - RNA, 19 nt, Artificial Sequence
  Description of Artificial Sequence: Synthetic oligonucleotide
caauaaggcucaugcacaa

SEQ ID NO: 1702 - RNA, 19 nt, Artificial Sequence
  Description of Artificial Sequence: Synthetic oligonucleotide
uugugcaugagccuuauug

SEQ ID NO: 1703 - RNA, 19 nt, Artificial Sequence
  Description of Artificial Sequence: Synthetic oligonucleotide
aggaucaacgacgagaucg

SEQ ID NO: 1704 - RNA, 19 nt, Artificial Sequence
  Description of Artificial Sequence: Synthetic oligonucleotide
cgaucucgucguugauccu

SEQ ID NO: 1705 - RNA, 19 nt, Artificial Sequence
  Description of Artificial Sequence: Synthetic oligonucleotide
ucaugcacaauugguucga

SEQ ID NO: 1706 - RNA, 19 nt, Artificial Sequence
  Description of Artificial Sequence: Synthetic oligonucleotide
ucgaaccaauugugcauga

SEQ ID NO: 1707 - RNA, 19 nt, Artificial Sequence
  Description of Artificial Sequence: Synthetic oligonucleotide
ggaucaacgacgagaucga

SEQ ID NO: 1708 - RNA, 19 nt, Artificial Sequence
  Description of Artificial Sequence: Synthetic oligonucleotide
ucgaucucgucguugaucc

SEQ ID NO: 1709 - RNA, 19 nt, Artificial Sequence
  Description of Artificial Sequence: Synthetic oligonucleotide
agagcuuguggaaugaucc

SEQ ID NO: 1710 - RNA, 19 nt, Artificial Sequence
  Description of Artificial Sequence: Synthetic oligonucleotide
ggaucauuccacaagcucu

SEQ ID NO: 1711 - RNA, 19 nt, Artificial Sequence
  Description of Artificial Sequence: Synthetic oligonucleotide
gaggaucaacgacgagauc

SEQ ID NO: 1712 - RNA, 19 nt, Artificial Sequence
  Description of Artificial Sequence: Synthetic oligonucleotide
gaucucgucguugauccuc

SEQ ID NO: 1713 - RNA, 19 nt, Artificial Sequence
  Description of Artificial Sequence: Synthetic oligonucleotide
ggaggaucaacgacgagau

SEQ ID NO: 1714 - RNA, 19 nt, Artificial Sequence
  Description of Artificial Sequence: Synthetic oligonucleotide
aucucgucguugauccucc

SEQ ID NO: 1715 - RNA, 19 nt, Artificial Sequence
  Description of Artificial Sequence: Synthetic oligonucleotide
uuuugagaauccauaugua

SEQ ID NO: 1716 - RNA, 19 nt, Artificial Sequence
  Description of Artificial Sequence: Synthetic oligonucleotide
uacauauggauucucaaaa

SEQ ID NO: 1717 - RNA, 19 nt, Artificial Sequence
  Description of Artificial Sequence: Synthetic oligonucleotide
caaggaagcccggaggauc

SEQ ID NO: 1718 - RNA, 19 nt, Artificial Sequence
  Description of Artificial Sequence: Synthetic oligonucleotide
gauccuccgggcuuccuug

SEQ ID NO: 1719 - DNA, 21 bp, Artificial Sequence
  Description of Artificial Sequence: Synthetic oligonucleotide
  Description of Combined DNA/RNA Molecule: Synthetic oligonucleotide
uauucccaccuagucgacutt

SEQ ID NO: 1720 - DNA, 21 bp, Artificial Sequence
  Description of Artificial Sequence: Synthetic oligonucleotide
  Description of Combined DNA/RNA Molecule: Synthetic oligonucleotide
agucgacuaggugggaauatt

SEQ ID NO: 1721 - DNA, 21 bp, Artificial Sequence
  Description of Artificial Sequence: Synthetic oligonucleotide
  Description of Combined DNA/RNA Molecule: Synthetic oligonucleotide
uucccaccuagucgacuactt

SEQ ID NO: 1722 - DNA, 21 bp, Artificial Sequence
  Description of Artificial Sequence: Synthetic oligonucleotide
  Description of Combined DNA/RNA Molecule: Synthetic oligonucleotide
guagucgacuaggugggaatt

SEQ ID NO: 1723 - DNA, 21 bp, Artificial Sequence
  Description of Artificial Sequence: Synthetic oligonucleotide
  Description of Combined DNA/RNA Molecule: Synthetic oligonucleotide
gcuuuugagaauccauaugtt

SEQ ID NO: 1724 - DNA, 21 bp, Artificial Sequence
  Description of Artificial Sequence: Synthetic oligonucleotide
  Description of Combined DNA/RNA Molecule: Synthetic oligonucleotide
cauauggauucucaaaagctt

SEQ ID NO: 1725 - DNA, 21 bp, Artificial Sequence
  Description of Artificial Sequence: Synthetic oligonucleotide
  Description of Combined DNA/RNA Molecule: Synthetic oligonucleotide
cggaggaucaacgacgagatt

SEQ ID NO: 1726 - DNA, 21 bp, Artificial Sequence
  Description of Artificial Sequence: Synthetic oligonucleotide
  Description of Combined DNA/RNA Molecule: Synthetic oligonucleotide
ucucgucguugauccuccgtt

SEQ ID NO: 1727 - DNA, 21 bp, Artificial Sequence
  Description of Artificial Sequence: Synthetic oligonucleotide
  Description of Combined DNA/RNA Molecule: Synthetic oligonucleotide
aucugacucuaccaaauactt

SEQ ID NO: 1728 - DNA, 21 bp, Artificial Sequence
  Description of Artificial Sequence: Synthetic oligonucleotide
  Description of Combined DNA/RNA Molecule: Synthetic oligonucleotide
guauuugguagagucagautt

SEQ ID NO: 1729 - DNA, 21 bp, Artificial Sequence
  Description of Artificial Sequence: Synthetic oligonucleotide
  Description of Combined DNA/RNA Molecule: Synthetic oligonucleotide
acacaauaaggcucaugcatt

SEQ ID NO: 1730 - DNA, 21 bp, Artificial Sequence
  Description of Artificial Sequence: Synthetic oligonucleotide
  Description of Combined DNA/RNA Molecule: Synthetic oligonucleotide
ugcaugagccuuauugugutt

SEQ ID NO: 1731 - DNA, 21 bp, Artificial Sequence
  Description of Artificial Sequence: Synthetic oligonucleotide
  Description of Combined DNA/RNA Molecule: Synthetic oligonucleotide
aggaucauccacgggucggtt

SEQ ID NO: 1732 - DNA, 21 bp, Artificial Sequence
  Description of Artificial Sequence: Synthetic oligonucleotide
  Description of Combined DNA/RNA Molecule: Synthetic oligonucleotide
ccgacccguggaugauccutt

SEQ ID NO: 1733 - DNA, 21 bp, Artificial Sequence
  Description of Artificial Sequence: Synthetic oligonucleotide
  Description of Combined DNA/RNA Molecule: Synthetic oligonucleotide
cccauacaaguaugaacactt

SEQ ID NO: 1734 - DNA, 21 bp, Artificial Sequence
  Description of Artificial Sequence: Synthetic oligonucleotide
  Description of Combined DNA/RNA Molecule: Synthetic oligonucleotide
guguucauacuuguaugggtt

SEQ ID NO: 1735 - DNA, 21 bp, Artificial Sequence
  Description of Artificial Sequence: Synthetic oligonucleotide
  Description of Combined DNA/RNA Molecule: Synthetic oligonucleotide
caauaaggcucaugcacaatt

SEQ ID NO: 1736 - DNA, 21 bp, Artificial Sequence
  Description of Artificial Sequence: Synthetic oligonucleotide
  Description of Combined DNA/RNA Molecule: Synthetic oligonucleotide
uugugcaugagccuuauugtt

SEQ ID NO: 1737 - DNA, 21 bp, Artificial Sequence
  Description of Artificial Sequence: Synthetic oligonucleotide
  Description of Combined DNA/RNA Molecule: Synthetic oligonucleotide
aggaucaacgacgagaucgtt

SEQ ID NO: 1738 - DNA, 21 bp, Artificial Sequence
  Description of Artificial Sequence: Synthetic oligonucleotide
  Description of Combined DNA/RNA Molecule: Synthetic oligonucleotide
cgaucucgucguugauccutt

SEQ ID NO: 1739 - DNA, 21 bp, Artificial Sequence
  Description of Artificial Sequence: Synthetic oligonucleotide
  Description of Combined DNA/RNA Molecule: Synthetic oligonucleotide
ucaugcacaauugguucgatt

SEQ ID NO: 1740 - DNA, 21 bp, Artificial Sequence
  Description of Artificial Sequence: Synthetic oligonucleotide
  Description of Combined DNA/RNA Molecule: Synthetic oligonucleotide
ucgaaccaauugugcaugatt

SEQ ID NO: 1741 - DNA, 21 bp, Artificial Sequence
  Description of Artificial Sequence: Synthetic oligonucleotide
  Description of Combined DNA/RNA Molecule: Synthetic oligonucleotide
ggaucaacgacgagaucgatt

SEQ ID NO: 1742 - DNA, 21 bp, Artificial Sequence
  Description of Artificial Sequence: Synthetic oligonucleotide
  Description of Combined DNA/RNA Molecule: Synthetic oligonucleotide
ucgaucucgucguugaucctt

SEQ ID NO: 1743 - DNA, 21 bp, Artificial Sequence
  Description of Artificial Sequence: Synthetic oligonucleotide
  Description of Combined DNA/RNA Molecule: Synthetic oligonucleotide
agagcuuguggaaugaucctt

SEQ ID NO: 1744 - DNA, 21 bp, Artificial Sequence
  Description of Artificial Sequence: Synthetic oligonucleotide
  Description of Combined DNA/RNA Molecule: Synthetic oligonucleotide
ggaucauuccacaagcucutt

SEQ ID NO: 1745 - DNA, 21 bp, Artificial Sequence
  Description of Artificial Sequence: Synthetic oligonucleotide
  Description of Combined DNA/RNA Molecule: Synthetic oligonucleotide
gaggaucaacgacgagauctt

SEQ ID NO: 1746 - DNA, 21 bp, Artificial Sequence
  Description of Artificial Sequence: Synthetic oligonucleotide
  Description of Combined DNA/RNA Molecule: Synthetic oligonucleotide
gaucucgucguugauccuctt

SEQ ID NO: 1747 - DNA, 21 bp, Artificial Sequence
  Description of Artificial Sequence: Synthetic oligonucleotide
  Description of Combined DNA/RNA Molecule: Synthetic oligonucleotide
ggaggaucaacgacgagautt

SEQ ID NO: 1748 - DNA, 21 bp, Artificial Sequence
  Description of Artificial Sequence: Synthetic oligonucleotide
  Description of Combined DNA/RNA Molecule: Synthetic oligonucleotide
aucucgucguugauccucctt

SEQ ID NO: 1749 - DNA, 21 bp, Artificial Sequence
  Description of Artificial Sequence: Synthetic oligonucleotide
  Description of Combined DNA/RNA Molecule: Synthetic oligonucleotide
uuuugagaauccauauguatt

SEQ ID NO: 1750 - DNA, 21 bp, Artificial Sequence
  Description of Artificial Sequence: Synthetic oligonucleotide
  Description of Combined DNA/RNA Molecule: Synthetic oligonucleotide
uacauauggauucucaaaatt

SEQ ID NO: 1751 - DNA, 21 bp, Artificial Sequence
  Description of Artificial Sequence: Synthetic oligonucleotide
  Description of Combined DNA/RNA Molecule: Synthetic oligonucleotide
caaggaagcccggaggauctt

SEQ ID NO: 1752 - DNA, 21 bp, Artificial Sequence
  Description of Artificial Sequence: Synthetic oligonucleotide
  Description of Combined DNA/RNA Molecule: Synthetic oligonucleotide
gauccuccgggcuuccuugtt

SEQ ID NO: 1753 - RNA, 19 nt, Artificial Sequence
  Description of Artificial Sequence: Synthetic oligonucleotide
cggaggaucaacgacgaga

SEQ ID NO: 1754 - RNA, 19 nt, Artificial Sequence
  Description of Artificial Sequence: Synthetic oligonucleotide
ucucgucguugauccuccg

SEQ ID NO: 1755 - RNA, 19 nt, Artificial Sequence
  Description of Artificial Sequence: Synthetic oligonucleotide
aucugacucuaccaaauac

SEQ ID NO: 1756 - RNA, 19 nt, Artificial Sequence
  Description of Artificial Sequence: Synthetic oligonucleotide
guauuugguagagucagau

SEQ ID NO: 1757 - DNA, 21 bp, Artificial Sequence
  Description of Artificial Sequence: Synthetic oligonucleotide
  Description of Combined DNA/RNA Molecule: Synthetic oligonucleotide
cggaggaucaacgacgagatt

SEQ ID NO: 1758 - DNA, 21 bp, Artificial Sequence
  Description of Artificial Sequence: Synthetic oligonucleotide
  Description of Combined DNA/RNA Molecule: Synthetic oligonucleotide
ucucgucguugauccuccgtt

SEQ ID NO: 1759 - DNA, 21 bp, Artificial Sequence
  Description of Artificial Sequence: Synthetic oligonucleotide
  Description of Combined DNA/RNA Molecule: Synthetic oligonucleotide
aucugacucuaccaaauactt

SEQ ID NO: 1760 - DNA, 21 bp, Artificial Sequence
  Description of Artificial Sequence: Synthetic oligonucleotide
guauuugguagagucagautt

SEQ ID NO: 1761 - DNA, 2188 bp, Homo sapiens
agggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaaaaaaaaaaaaaaaaaaa

SEQ ID NO: 1762 - DNA, 1080 bp, Rattus norvegicus
atgactctggagtccatcatggcgtgctgcctgagcgaggaggccaaggaagcccggaggatcaacgacgagatcgagcggcagctgcgcagggacaagcgcgacgcccgccgggagctcaagctgctgctgctggggacaggggagagtggcaagagtaccttcattaagcagatgaggatcatccacgggtcggggtactctgatgaagacaagaggggctttaccaaactggtgtatcagaacatctttacagccatgcaggccatggtcagagctatggacactctcaagatcccatacaagtatgaacacaataaggctcatgcacaattggttcgagaggttgatgtggagaaggtgtctgcttttgagaatccatatgtagacgcaataaagagcttgtggaatgatcctggaatccaggaatgctacgatagacggcgagaatatcagctatctgactctaccaaatactatctgaacgacttggaccgtgtggctgacccttcctatctgcctacacaacaagatgtgcttagagttcgagtccccaccacagggatcattgagtaccccttcgacttacagagtgtcatcttcagaatggtcgatgtaggaggccaaaggtcagagagaagaaaatggatacactgctttgaaaacgtcacctcgatcatgtttctggtagcgcttagcgaatacgatcaagttcttgtggagtcagacaatgagaaccgaatggaggagagcaaagcactctttagaaccattatcacatatccctggttccagaactcctctgttattctgttcttaaacaagaaagatcttctagaggagaaaattatgtattcccacctagtcgactacttcccagaatatgatggaccccagagagatgcccaggcagcacgagaattcatcctgaagatgttcgtggacctgaaccccgacagtgacaaaatcatctactcgcacttcacgtgtgccacagacacggagaacatccgcttcgtgtttgctgctgtcaaggacaccatcctgcagctgaacctgaaggagtacaatctggtctaa

We claim:

1. A double-stranded ribonucleic acid (dsRNA) for inhibiting expression of a G-alpha q subunit (GNAQ) of a heterotrimeric G gene, comprising a sense strand and an antisense strand complementary to at least the first 11 nucleotides of SEQ ID NO:1421, wherein each strand is at least 15 nucleotides in length.

2. The dsRNA of claim 1, wherein the sense strand consists of SEQ ID NO:1579 (cAAuuuGcAuAAuAcuAAudTdT) and the antisense strand consists of SEQ ID NO:1580 (AUuAGuAUuAUGcAAAUUGdTdT) wherein each strand includes 2'-O-methyl ribonucleotides as indicated by a lower case letter "c" and "u".

3. The dsRNA of claim 1, wherein the antisense strand is complementary to at least 15 contiguous nucleotides of SEQ ID NO:1421.

4. The dsRNA of claim 1, wherein the sense strand comprises 15 or more contiguous nucleotides of SEQ ID NO:1421 or SEQ ID NO:1579.

5. The dsRNA of claim 1, wherein the antisense strand comprises 15 or more contiguous nucleotides of SEQ ID NO:1422 or SEQ ID NO:1580.

6. The dsRNA of claim 1, wherein the sense strand sequence comprises SEQ ID NO:1421 and the antisense strand sequence comprises of SEQ ID NO:1422.

7. The dsRNA of claim 1, wherein administration of 0.1 nM of the dsRNA to a A375 cell results in about 66% inhibition of GNAQ mRNA expression as measured by a real time PCR assay or administration of 1 nM of the dsRNA to a A375 cell results in about 61% inhibition of GNAQ mRNA expression as measured by a real time PCR assay or administration of 1 nM of the dsRNA to a A579 cell results in about 82% inhibition of GNAQ mRNA expression as measured by a real time PCR assay or administration of 10 nM of the dsRNA to a OMM1.3 cell results in about 42% inhibition of GNAQ mRNA expression as measured by a real time PCR assay or administration of the dsRNA to a UMEL202 cell results in about 81% inhibition of GNAQ mRNA expression as measured by a real time PCR assay.

8. The dsRNA of claim 1, wherein the antisense strand is complementary to 16, 17, or 18 nucleotides of SEQ ID NO:1421.

9. The dsRNA of claim 1, wherein the antisense strand is complementary to 19 nucleotides of SEQ ID NO:1421.

10. The dsRNA of claim 1, wherein each strand is no more than 30 nucleotides in length.

11. The dsRNA of claim 1, wherein at least one strand comprises a 3' overhang of at least 1 nucleotide.

12. The dsRNA of claim 1, wherein each strand comprises a 3' overhang consisting of 2 nucleotides.

13. The dsRNA of claim 1, wherein each strand comprises a 3' overhang consisting of dTdT.

14. The dsRNA of claim 1 or claim 6, comprising a modification that causes the dsRNA to have increased stability in a biological sample.

15. The dsRNA of claim 1 or claim 6, wherein said dsRNA comprises at least one modified nucleotide.

16. The dsRNA of claim 14, wherein said modified nucleotide is selected from the group of: a 2'-O-methyl modified nucleotide, a nucleotide comprising a 5'-phosphorothioate group, and a terminal nucleotide linked to a cholesteryl derivative or dodecanoic acid bisdecylamide group.

17. The dsRNA of claim 14, wherein said modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

18. The dsRNA of claim 14, comprising at least one 2'-O-methyl modified nucleotide and at least one 2'-deoxythymidine-3'-phosphate nucleotide comprising a 5'-phosphorothioate group.

19. The dsRNA of claim 14, wherein the sense strand comprises all 2'-O-methyl modified pyrimidines and the antisense strand comprises 2'-O-methyl modified pyrimidines when the pyrimidine is adjacent to A and each strand comprises dTdT at the 3' end.

20. The dsRNA of claim 14, wherein the sense strand comprises all 2'-O-methyl modified pyrimidines and the antisense strand comprises 2'-O-methyl modified pyrimidines when the pyrimidine is adjacent to A and each strand comprises dTsdT at the 3' end.

21. The dsRNA of claim 14, wherein the sense strand comprises all 2'-O-methyl modified pyrimidines and the antisense strand comprises 2'-O-methyl modified pyrimidines when a) the pyrimidine is adjacent to A or b) the pyrimidine is a uracil adjacent to a U or a G, and each strand comprises dTsdT at the 3' end.

22. The dsRNA of claim 1 or claim 2 or claim 6, further comprising a ligand.

23. The dsRNA of claim 22, wherein the ligand is conjugated to the 3'-end of the sense strand of the dsRNA.

24. A composition for inhibiting expression of a GNAQ gene comprising the dsRNA of claim 1 or claim 2 or claim 6 and pharmaceutical formulation.

25. The composition of claim 24, wherein the pharmaceutical formulation is a lipid formulation.

26. The composition of claim 24, wherein the pharmaceutical formulation is a a (6Z,9Z,28Z,31Z)-heptatriaconta-6,9,28,31-tetraen-19-yl 4-(dimethylamino)butanoate (MC3) comprising formulation, or a LNP11 formulation.

27. An isolated cell containing the dsRNA of claim 1 or claim 2 or claim 6.

28. A vector comprising a nucleotide sequence that encodes at least one strand of the dsRNA of claim 1 or claim 6.

29. An isolated cell comprising the vector of claim 28.

30. The dsRNA of claim 1, wherein said dsRNA, upon contact with a cell expressing said GNAQ, inhibits expression of said GNAQ gene by at least 40% compared to a cell not so contacted.

31. The dsRNA of claim 1, wherein the dsRNA has an IC50 of less than 10 pM.

32. A method of inhibiting GNAQ expression in a cell, the method comprising:
(a) introducing into the cell the dsRNA of claim 1 or claim 2 or claim 6; and
(b) maintaining the cell produced in step (a) for a time sufficient to obtain degradation of the mRNA transcript of a GNAQ gene, thereby inhibiting expression of the GNAQ gene in the cell.

33. A method of treating a disorder mediated by GNAQ expression comprising administering to a human in need of such treatment a therapeutically effective amount of the dsRNA of claim 1 or claim 2 or claim 6.

34. The method of claim 33, wherein the human has uveal melanoma, cutaneous melanoma, Blue nevi, Nevi of Ota, a small lung tumor, or a neuroendocrine tumors.

35. The composition of claim 24, wherein the pharmaceutical formulation is a (6Z,9Z,28Z,31Z)-heptatriaconta-6,9,28,31-tetraen-19-yl 4-(dimethylamino)butanoate (MC3) comprising formulation.

36. The composition of claim 24, wherein the pharmaceutical formulation is a LNP11 formulation.

* * * * *

UNITED STATES PATENT AND TRADEMARK OFFICE
CERTIFICATE OF CORRECTION

PATENT NO. : 8,324,368 B2  Page 1 of 1
APPLICATION NO. : 12/635630
DATED : December 4, 2012
INVENTOR(S) : Jared Gollob et al.

It is certified that error appears in the above-identified patent and that said Letters Patent is hereby corrected as shown below:

In the Claims
Column 129, line 14, delete "claim 14" and insert --claim 15--
Column 129, line 19, delete "claim 14" and insert --claim 15--

Signed and Sealed this
Twenty-second Day of October, 2013

Teresa Stanek Rea
*Deputy Director of the United States Patent and Trademark Office*